United States Patent
Kuznetsov et al.

(10) Patent No.: US 11,361,845 B2
(45) Date of Patent: Jun. 14, 2022

(54) METHODS FOR RULE-BASED GENOME DESIGN

(71) Applicant: President and Fellows of Harvard College, Cambridge, MA (US)

(72) Inventors: Gleb Kuznetsov, Cambridge, MA (US); Marc J. Lajoie, Cambridge, MA (US); Matthieu M. Landon, Boston, MA (US); Michael G. Napolitano, Brookline, MA (US); Daniel Bryan Goodman, Cambridge, MA (US); Christopher J. Gregg, Melrose, MA (US); George M. Church, Brookline, MA (US); Nili Ostrov, Brookline, MA (US)

(73) Assignee: President and Fellows of Harvard College, Cambridge, MA (US)

(*) Notice: Subject to any disclaimer, the term of this patent is extended or adjusted under 35 U.S.C. 154(b) by 0 days.

(21) Appl. No.: 16/309,645

(22) PCT Filed: Jun. 15, 2017

(86) PCT No.: PCT/US2017/037596
§ 371 (c)(1),
(2) Date: Dec. 13, 2018

(87) PCT Pub. No.: WO2017/218727
PCT Pub. Date: Dec. 21, 2017

(65) Prior Publication Data
US 2020/0055903 A1    Feb. 20, 2020

Related U.S. Application Data

(60) Provisional application No. 62/350,468, filed on Jun. 15, 2016.

(51) Int. Cl.
| | | |
|---|---|---|
| *G16B 35/10* | (2019.01) | |
| *G16B 20/50* | (2019.01) | |
| *C07K 14/245* | (2006.01) | |
| *C12N 15/10* | (2006.01) | |
| *C12P 21/00* | (2006.01) | |
| *A61K 38/00* | (2006.01) | |

(52) U.S. Cl.
CPC ............ *G16B 35/10* (2019.02); *C07K 14/245* (2013.01); *C12N 15/1089* (2013.01); *C12P 21/00* (2013.01); *G16B 20/50* (2019.02); *A61K 38/00* (2013.01)

(58) Field of Classification Search
None
See application file for complete search history.

(56) References Cited

U.S. PATENT DOCUMENTS

| | | |
|---|---|---|
| 2006/0286627 A1 | 12/2006 | Bochner et al. |
| 2007/0004041 A1 | 1/2007 | Church et al. |
| 2010/0209454 A1 | 8/2010 | Wimmer et al. |
| 2011/0172930 A1 | 7/2011 | Pancoska et al. |

OTHER PUBLICATIONS

Boeke, Jef D. et al., "The Genome Project-Write", Science, vol. 353, No. 6295, Jun. 2, 2016 (Jun. 2, 2016), pp. 126-127.
European Search Report dated Nov. 29, 2019 for EP Application No. 17814059.6.
Fredens, Julius et al., "Total synthesis of *Escherichia coli* with a recoded genome", Nature, Macmillan Journals Ltd., Etc., London, vol. 569, No. 7757, May 15, 2019 (May 15, 2019), pp. 514-518.
Goodman, Daniel B. et al., "Millstone: software for multiplex microbial genome analysis and engineering", Genome Biology, vol. 18, No. 1, May 25, 2017 (May 25, 2017).
Hoon Hong, Seok et al., "Non-standard amino acid incorporation into proteins using *Escherichia coli* cell-free protein synthesis", Frontiers in Chemistry, vol. 2, Jun. 10, 2014 (Jun. 10, 2014).
Lajoie, M.J. et al., "Overcoming challenges in Engineering the Genetic Code", Journal of Molecular Biology, Academic Press, United Kingdom, vol. 428, No. 5, Sep. 5, 2015 (Sep. 5, 2015), pp. 1004-1021.
Lajoie, M.J. et al., "Probing the Limits of Genetic Recoding in Essential Genes", Science, vol. 342, No. 6156, Oct. 18, 2013 (Oct. 2013-2018), pp. 361-363.
Lau, Yu Heng et al., "Large-scale recoding of a bacterial genome by iterative recombineering of synthetic DNA", Nucleic Acids Research, vol. 45, No. 11, Jun. 20, 2017 (Jun. 20, 2017), May 12, 2017 (May 12, 2017), pp. 6971-6980.
Mandell, Daniel J. et al., "Biocontainment of genetically modified organisms by synthetic protein design", Nature, vol. 518, No. 7537, Jan. 21, 2015 (Jan. 21, 2015), pp. 55-60.

(Continued)

*Primary Examiner* — Kagnew H Gebreyesus
(74) *Attorney, Agent, or Firm* — Banner & Witcoff, Ltd.

(57) ABSTRACT

Methods and systems for designing, testing, and validating genome designs based on rules or constraints or conditions or parameters or features and scoring are described herein. A computer-implemented method includes receiving data for a known genome and a list of alleles, identifying and removing occurrences of each allele in the known genome, determining a plurality of allele choices with which to replace occurrences in the known genome, generating a plurality of alternative gene sequences for a genome design based on the known genome, wherein each alternative gene sequence comprises a different allele choice, applying a plurality of rules or constraints or conditions or parameters or features to each alternative gene sequence by assigning a score for each rule or constraint or condition or parameter or feature in each alternative gene sequence, resulting in scores for the applied plurality of rules or constraints or conditions or parameters or features, scoring each alternative gene sequence based on a weighted combination of the scores for the plurality of rules or constraints or conditions or parameters or features, and selecting at least one alternative gene sequence as the genome design based on the scoring.

17 Claims, 72 Drawing Sheets

Specification includes a Sequence Listing.

(56) References Cited

OTHER PUBLICATIONS

Mukai, Takahito et al., "Highly reproductive *Escherichia coli* cells with no specific assignment to the UAG codon", Scientific Reports, vol. 5, No. 1, May 18, 2015 (May 18, 2015).
Napolitano, Michael G. et al., "Emergent rules for codon choice elucidated by editing rare arginine codons in *Escherichia coli*", Proceedings of the National Academy of Sciences, vol. 113, No. 38, Sep. 6, 2016 (Sep. 6, 2016), pp. E5588-E5597.
Ostrov, Nill et al., "Design, synthesis, and testing toward a 57-codon genome", Science, vol. 353, No. 6301, Aug. 19, 2016 (Aug. 19, 2016), pp. 819-822.
Rogers, J.M. et al., "Discovering functional, non-proteinogenic amino acid containing, peptides using genetic code reprogramming", Organic & Biomolecular Chemistry, vol. 13, No. 36, Jan. 1, 2015, pp. 9353-9363.
Rovner, Alexis J., "Recoded organisms engineered to depend on synthetic amino acids", Nature, vol. 518, No. 7537, Jan. 21, 2015 (Jan. 21, 2015), pp. 89-93.
Terasaka, Naohiro et al., "Recent Developments of Engineered Translational Machineries for the Incorporation of Non-Canonical Amino Acids into Polypeptides", Int. J. Mol. Sci., vol. 16, No. 3, Jan. 1, 2015 (Jan. 1, 2015), pp. 6513-6531.
Bonde et al., "MODEST: a web-based design tool for oligonucleotide-mediated genome engineering and Yecombineering," Nucleic Acids Research, vol. 42, Web Server issue pp. W408-W415 (May 16, 2014).
Millstone: genome design and analysis for synthetic biology, https://web.archive.org/web/20160514082157/http://churchlab.github.io/millstone/(2014).
Lajoie et al., "Genomically Recoded Organisms Expand Biological Functions," Science, vol. 342, No. 6156, pp. 357-360 (Oct. 18, 2013).

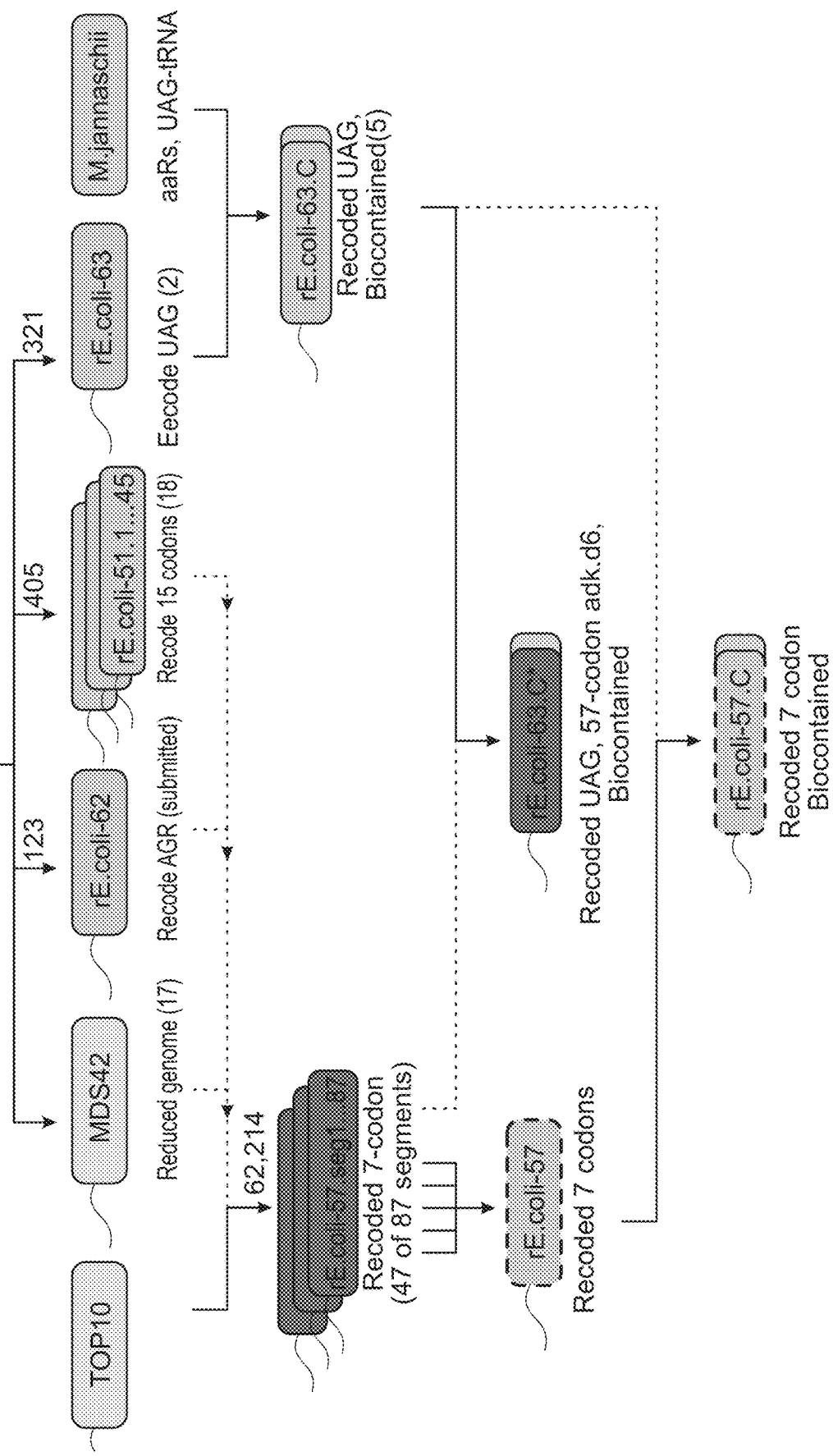

FIG. 8
Forbidden Codons
AGA, AGG, AGC, AGU,
UUG, UUA, UAG
Genbank File
*E. coli* MDS42
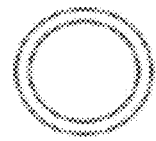
(1) Fix overlaps
(2) Replace forbidden codons in genes
(3) Fix technological requirements
(3) Partition genome into segments
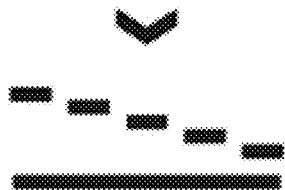
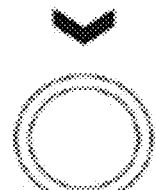
2-4 kb synthesis
fragments
Genbank File
rE.coli-57

A Fix overlaps (202 instances)

(i) Use minimal change when possible (ii) Split overlaps, preserve RBS, codon-shuffle homologous region Minimize changes in GC-content, secondary structure (ss) folding energy Remove homopolymer runs to increase synthesis success rate (158 instances)

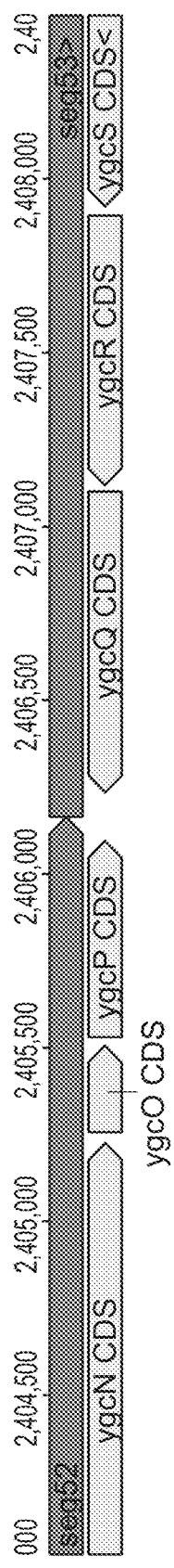
FIG. 9F Partition genome into 87 ~kb "segments" at operon boundaries
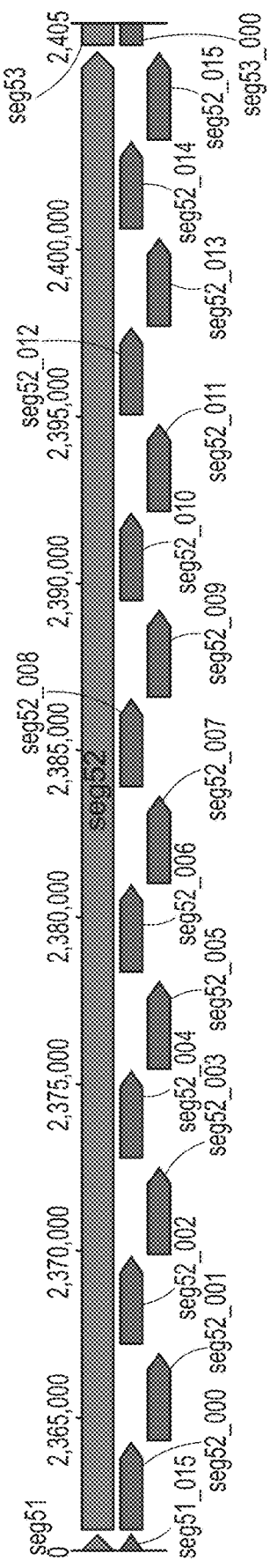
FIG. 9G Partition each "segment" into ~15 "fragments" of size 2 - 4 kb for vendor synthesis

FIG. 17

| | 1 | | | | 10 | | | | 20 | | | | 30 | | | | 40 | |
|---|---|---|---|---|---|---|---|---|---|---|---|---|---|---|---|---|---|---|
| WT | ATG AGC ... TGG GAA ATT GAA CGA ATT AAA AGC ATG AAA ATT ACT CCC ACC CGC | | | | | | | | | | | | | | | | | |
| | M S W E I E R I K S M K I T P T R | | | | | | | | | | | | | | | | | |
| accD.Initial | ATG AGC TGG GAA ATT GAA CGA ATT AAA AGC AAC ATT ACT CCC ACC CGC | | | | | | | | | | | | | | | | | |
| | M S W E I E R I K S N I T P T R | | | | | | | | | | | | | | | | | |
| accD.Improved | ATG TCG GAG ATT GAA CGA ATT AAA AGC AAC ATT ACT CCC ACC CGC | | | | | | | | | | | | | | | | | |
| | M S W E I E R I K S N I T P T R | | | | | | | | | | | | | | | | | |
| accD.Viable | ATG TCG GAG ATT CAA CGA ATT AAA AGC AAC ATT ACT CCC ACC CGC | | | | | | | | | | | | | | | | | |
| | M S W E I Q R I K A N I T P T R | | | | | | | | | | | | | | | | | |

| | 110 | | | | 120 | | | | 130 | | | | 140 | | | |
|---|---|---|---|---|---|---|---|---|---|---|---|---|---|---|---|---|
| WT | TAC CGC GCT GAG CTG GAA CGT AAT GAG GTT ACT TGT AAG TGT | | | | | | | | | | | | | | | |
| | Y R A E L E R N E V T C K C | | | | | | | | | | | | | | | |
| accD.Initial | TAC CGC GCT GAG CTG GAA CGT AAT GAG GTC ACT TGT CCC TGT | | | | | | | | | | | | | | | |
| | Y R A E L E R N E V T C P C | | | | | | | | | | | | | | | |
| accD.Improved | TAC CGC GCT GAG CTG GAA CGT AAT GAG GTC ACT TGT CCC TGT | | | | | | | | | | | | | | | |
| | Y R A E L E R N E V T C P C | | | | | | | | | | | | | | | |
| accD.Viable | TAC CAA GCT GAG CTG GAA CGT AAT GAG GTC ACT TGT CCC TGT | | | | | | | | | | | | | | | |
| | Y Q A E L E R N E V T C P C | | | | | | | | | | | | | | | |

| | 210 | | | | 220 | | | | 230 | | | | 240 | | | |
|---|---|---|---|---|---|---|---|---|---|---|---|---|---|---|---|---|
| WT | GGA AGC GTG GAG CTG GGT AGT GAG CTT GAG CCG AAA GAT GTG | | | | | | | | | | | | | | | |
| | G S V E L G S E L E P K D V | | | | | | | | | | | | | | | |
| accD.Initial | GGA AGA CTT GTG GAG CTG GGT AGT GAG CTT GAG CCG AAA GAT GTG | | | | | | | | | | | | | | | |
| | G S L V E L G S E L E P K D V | | | | | | | | | | | | | | | |
| accD.Improved | GGA TGG CTT GTG GAG CTG GGT AGT GAG CTT GAG CCG AAA CAT GTG | | | | | | | | | | | | | | | |
| | G S L V E L G S E L E P K H V | | | | | | | | | | | | | | | |
| accD.Viable | GGA TGG CTT GTG GAG CTG GGT AGT GAG CTT GAG CCG AAA CAT GTG | | | | | | | | | | | | | | | |
| | G S L V E L G S E L E P K H V | | | | | | | | | | | | | | | |

| | | | | | | | | | | | |
|---|---|---|---|---|---|---|---|---|---|---|---|
| WT | GAA<br>E | ACC<br>T | GGC<br>G | GAA<br>E | AAA<br>K | GAT<br>D | GCG<br>A | CTG<br>L | 310<br>GTG<br>V | ATG<br>N | AAA<br>K | 340<br>GGT<br>G | ACT<br>T | CTG<br>L |
| accD.Initial | GAA<br>E | ACC<br>T | GGC<br>G | GAA<br>E | AAA<br>K | GAT<br>D | GCG<br>A | CTG<br>L | GTG<br>V | ATG<br>N | AAA<br>K | GGC<br>G | ACT<br>T | CTG<br>L |
| accD.Improved | GAA<br>E | ACC<br>T | GGC<br>G | GAA<br>E | AAA<br>K | GAT<br>D | GCG<br>A | CTG<br>L | GTG<br>V | ATG<br>N | AAA<br>K | GGC<br>G | ACT<br>T | CTG<br>L |
| accD.Viable | GAA<br>E | ACC<br>T | GGC<br>G | GAA<br>E | AAA<br>K | GAT<br>D | GCG<br>A | CTG<br>L | GTG<br>V | ATG<br>N | AAA<br>K | GGC<br>G | ACT<br>T | CTG<br>L |
| WT | GGG<br>G | GTT<br>V | GTG<br>V | GGT<br>G | GCA<br>A | 410<br>GTT<br>F | 430<br>GTT<br>V | GCC<br>A | GTT<br>V | 440<br>GAG<br>E | GTT<br>V | GCG<br>A |
| accD.Initial | GGG<br>G | TCT<br>S | GTG<br>V | GGT<br>G | GCA<br>A | TTC<br>F | GTG<br>V | GCC<br>A | GTT<br>V | GAG<br>E | CAG<br>Q | GCG<br>A |
| accD.Improved | GGG<br>G | TCT<br>S | GTG<br>V | GGT<br>G | GCA<br>A | TTC<br>F | GTG<br>V | GCC<br>A | GTT<br>V | GAG<br>E | CAG<br>Q | GCG<br>A |
| accD.Viable | GGG<br>G | TCT<br>S | GTG<br>V | GGT<br>G | GCA<br>A | TTC<br>F | GTG<br>V | GCC<br>A | GTT<br>V | GAG<br>E | CAG<br>Q | GCG<br>A |
| WT | CAG<br>Q | GAA<br>E | 510<br>GCA<br>A | ATG<br>M | 520<br>CTG<br>L | TCG<br>S | ATG<br>M | GTG<br>Q | GCG<br>A | 540<br>AAA<br>K | TCT<br>S | GCG<br>A |
| accD.Initial | CAG<br>Q | GAA<br>E | GCA<br>A | ATG<br>M | CTG<br>L | TCG<br>S | ATG<br>M | CAG<br>Q | GCG<br>A | AAA<br>K | TCT<br>S | GCG<br>A |
| accD.Improved | CAG<br>Q | GAA<br>E | GCA<br>A | ATG<br>M | CTG<br>L | TCG<br>S | ATG<br>M | CAG<br>Q | GCG<br>A | AAA<br>K | TCT<br>S | GCG<br>A |
| accD.Viable | CAG<br>Q | GAA<br>E | GCA<br>A | ATG<br>M | CTG<br>L | TCG<br>S | ATG<br>M | CAG<br>Q | GCG<br>A | AAA<br>K | TCT<br>S | GCG<br>A |

FIG. 17 (cont.)

| 350 | | | | 360 | | | | 370 | | | | 380 | | | | 390 | | | | 400 | |
|---|---|---|---|---|---|---|---|---|---|---|---|---|---|---|---|---|---|---|---|---|---|
| TAT | GGA | ATG | ATG | GTT | GTT | GTC | GCT | GCA | GCG | GAG | TTC | TTC | GCC | TTT | ATG | ATG | GGC | GGT | TCA | ATG |
| Y | G | M | M | F | V | V | A | A | A | E | F | F | A | F | M | M | G | G | S | M |
| TAT | GGA | ATG | ATG | CCG | GTT | GTC | GCT | GCA | GCG | GAG | TTC | TTC | GCC | TTT | ATG | ATG | GGC | GGT | TCA | ATG |
| Y | G | M | M | P | V | V | A | A | A | E | F | F | A | F | M | M | G | G | S | M |
| TAT | GGA | ATG | ATG | CCG | GTT | GTC | GCT | GCA | GCG | GAG | TTC | TTC | GCC | TTT | ATG | ATG | GGC | GGT | TCA | ATG |
| Y | G | M | M | P | V | V | A | A | A | E | F | F | A | F | M | M | G | G | S | M |
| TAT | GGA | ATG | ATG | CCG | GTT | GTC | GCT | GCA | GCG | GAG | TTC | TTC | GCC | TTT | ATG | ATG | GGC | GGT | TCA | ATG |
| Y | G | M | M | P | V | V | A | A | A | E | F | F | A | F | M | M | G | G | S | M |

| 450 | | | | 460 | | | | 470 | | | | 480 | | | | 490 | | | | 500 | |
|---|---|---|---|---|---|---|---|---|---|---|---|---|---|---|---|---|---|---|---|---|
| CTG | GAA | GAT | AAC | AAA | TGC | GTT | CTG | ATG | TGT | TTC | TCC | GCA | TTT | GGT | ATG | GGT | GCA | CGT | ATG | ATG |
| L | E | D | N | K | C | F | L | I | C | F | S | A | F | G | M | G | A | K | N | M |
| CTG | GAA | GAT | AAC | AAA | TGC | CCG | CTG | ATC | TGC | TTC | TCC | GCC | TTT | GGT | GGC | GGT | GCA | CGT | ATG | ATG |
| L | E | D | N | K | C | P | L | I | C | F | S | A | F | G | G | G | A | K | N | M |
| CTG | GAA | GAT | AAC | AAA | TGC | CCG | CTG | ATC | TGC | TTC | TCC | GCC | TTT | GGT | GGC | GGT | GCA | CGT | ATG | ATG |
| L | E | D | N | K | C | P | L | I | C | F | S | A | F | G | G | G | A | K | N | M |
| CTG | GAA | GAT | AAC | AAA | TGC | CCG | CTG | ATC | TGC | TTC | TCC | GCC | TTT | GGT | GGC | GGT | GCA | CGT | ATG | ATG |
| L | E | D | N | K | C | P | L | I | C | F | S | A | F | G | G | G | A | K | N | M |

| 550 | | | | 560 | | | | 570 | | | | 580 | | | | 590 | | | | 600 | |
|---|---|---|---|---|---|---|---|---|---|---|---|---|---|---|---|---|---|---|---|---|
| GCA | CTG | AAA | ATG | CAG | GAG | CGC | GGC | TTG | TTG | TAT | ATT | ATG | GTG | ATG | CTG | GCA | CGT | ATG | GAC | GAC |
| A | L | K | M | Q | E | R | G | L | L | Y | I | M | V | M | L | A | R | M | D | D |
| GCA | CTG | AAA | ATG | CAG | GAG | CGC | GGC | CCG | :G | TAC | ATC | TCC | GTG | GTG | CTG | GCA | CGT | ACC | GAC | GAC |
| A | L | K | M | Q | E | R | G | P | L | Y | I | S | V | V | L | A | R | T | D | D |
| GCA | CTG | AAA | ATG | CAG | GAG | CGC | GGC | CCG | :G | TAC | ATC | TCC | GTG | GTG | CTG | GCA | CGT | ACC | GAC | GAC |
| A | L | K | M | Q | E | R | G | P | L | Y | I | S | V | V | L | A | R | T | D | D |
| GCA | CTG | AAA | ATG | CAG | GAG | CGC | GGC | CCG | :G | TAC | ATC | TCC | GTG | GTG | CTG | GCA | CGT | ACC | GAC | GAC |
| A | L | K | M | Q | E | R | G | P | L | Y | I | S | V | V | L | A | R | T | D | D |

| | Day 1 | | Day 7 | |
|---|---|---|---|---|
| | SC | SCA | SC | SCA |
| C321.ΔA.adk.d6 | 5.98E-07 ± 1.41E-07 | 1.16E-05 ± 2.27E-06 | 1.14E-05 ± 4.35E-06 | 4.43E-05 ± 4.91E-06 |
| C321.ΔA.adk.d6_tyrS.d8_bipARS.d7 | < 2.18E-12 | < 2.18E-12 | < 2.18E-12 | < 2.18E-12 |
| C321.ΔA.adk.d6.RC | 2.64E-06 ± 4.03E-07 | 4.50E-05 ± 5.05E-06 | 7.93E-07 ± 4.97E-07 | 2.36E-05 ± 3.91E-06 |
| C321.ΔA.adk.d6.RC_tyrS.d8_bipARS.d7 | < 1E-7 | < 1E-7 | < 1E-7 | < 1E-7 |

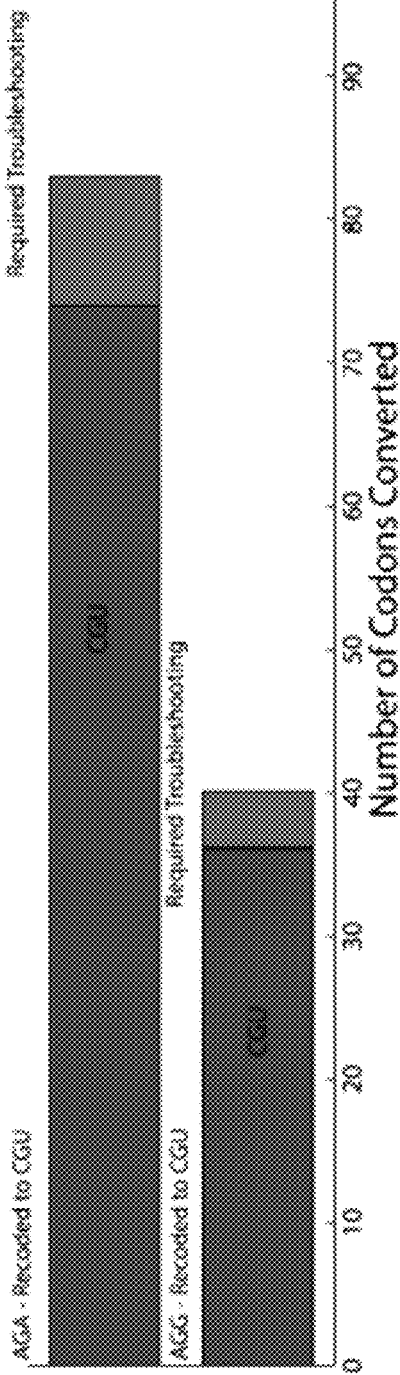
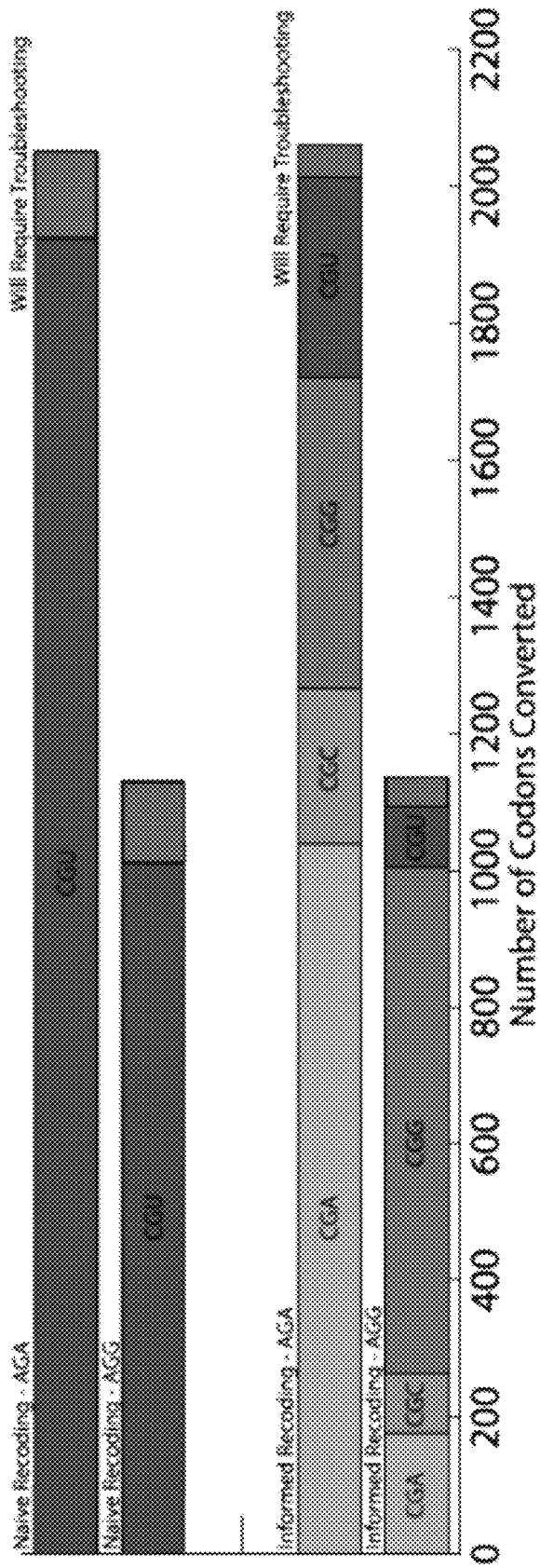
FIG. 25A
FIG. 25B

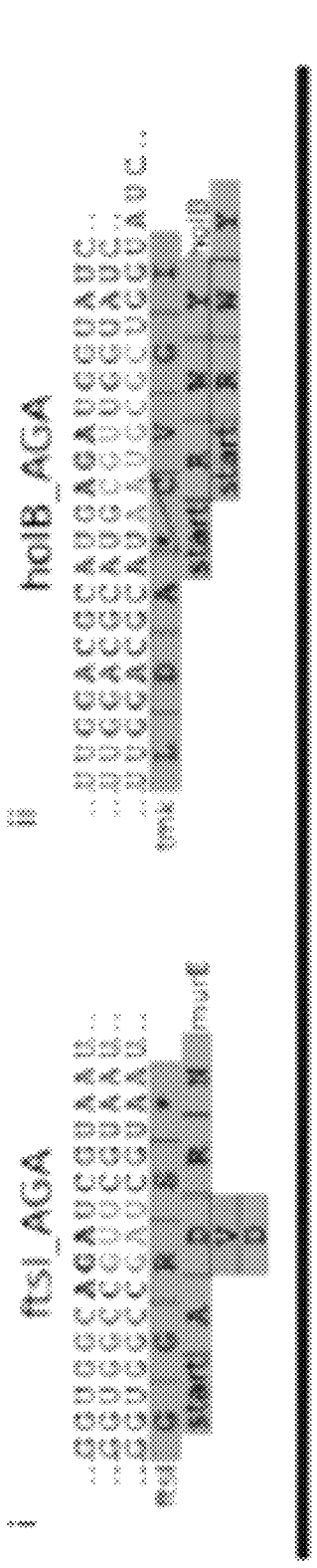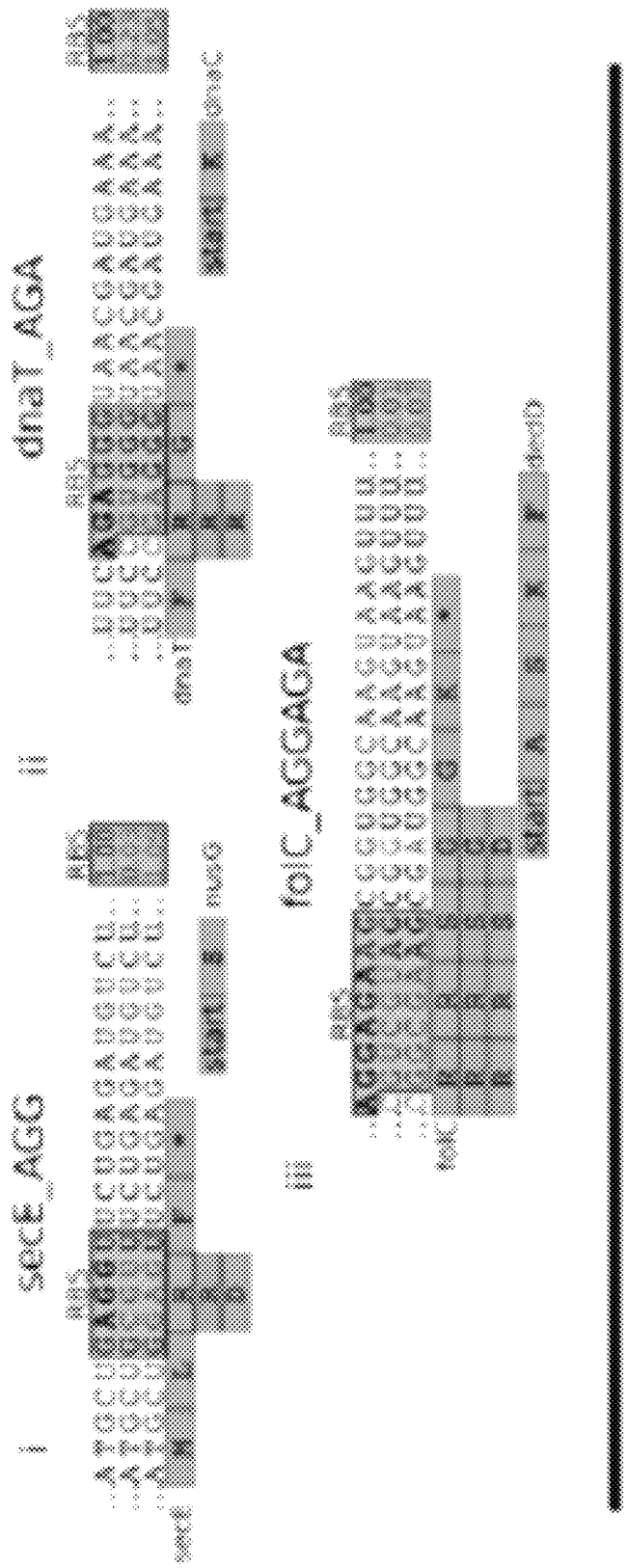
FIG. 27A
FIG. 27B

A

Free energy of secondary structure: -32.10 kcal/mol

B rnpA_CGT22

A
C
G
U

Free energy of secondary structure: -27.80 kcal/mol

C

*rnpA_CGG22*

Free energy of secondary structure: -32.20 kcal/mol

D rnpA_CTG22,CA45

Free energy of secondary structure: -30.00 kcal/mol

METHODS FOR RULE-BASED GENOME DESIGN

RELATED APPLICATIONS

This application is a National Stage Application under 35 U.S.C. 371 of PCT application PCT/US17/37596 designating the United States and filed Jun. 15, 2017; which claims the benefit of U.S. provisional application No. 62/350,468 filed on Jun. 15, 2016 each of which are hereby incorporated by reference in their entireties.

STATEMENT OF GOVERNMENT INTERESTS

This invention was made with government support under DE-FG02-02ER63445 awarded by Department of Energy and HR0011-13-1-0002 awarded by Department of Defense. The government has certain rights in the invention.

SEQUENCE LISTING

The instant application contains a Sequence Listing which has been submitted electronically in ASCII format and is hereby incorporated by reference in its entirety. Said ASCII copy, created on Jul. 18, 2017, is named 010498_00973-WO_SL.txt and is 550,915 bytes in size.

FIELD

Aspects described herein generally relate to genetic engineering and genetically modified cells and/or organisms. In particular, one or more aspects of the disclosure are directed to methods and computer software useful for genome design based on a predefined set of rules or conditions or parameters or features.

BACKGROUND

Genetically modified organisms (GMOs) are being used increasingly to produce human consumables such as fuels, commodity chemicals, and therapeutics. GMOs are also used in agriculture (e.g., golden rice, Roundup Ready® crops, Frostban), bioremediation (e.g., oil spills), and healthcare (e.g., Crohn's disease and oral inflammation). Modifications in commercially implemented GMOs may often be limited to heterologous gene expression and evolution under optimizing selection. Yet synthetic genomes that differ radically from any known organism may expand potential applications.

There has been considerable interest in creating minimal (Gibson et al., 2010) and recoded (Lajoie et al., 2013a; Lajoie et al., 2013b) genomes, but genomes are not yet understood well enough to design them from scratch. While in vivo genome engineering strategies may reduce the risk of creating nonfunctional genomes (Lajoie et al., 2013a; Lajoie et al., 2013b), rational design may still be indispensable for restricting the search space to create viable genomes with a desired function. Therefore, the field of genome engineering may be in dire need of general design rules or conditions or parameters or features, methods of eliciting these rules or conditions or parameters or features, and software that may be used to generate viable and constructible genomes.

SUMMARY

The following presents a simplified summary of various aspects described herein. This summary is not an extensive overview, and is not intended to identify key or critical elements or to delineate the scope of the claims. The following summary merely presents some concepts in a simplified form as an introductory prelude to the more detailed description provided below.

Aspects of the present disclosure provide methods, algorithms, computing platforms, and computer software for designing genomes based on satisfying a set of rules or conditions or parameters or features while minimizing disturbances to biologically relevant motifs, synthesizing the genome designs, and testing and validating the synthesized genome designs. A computing platform may generate genome designs and partition the genome designs into units that may be synthesized and/or edited, in which the genome designs satisfy user-specified constraints and maximize the probability of biological viability and constructability. Units or individual components of the redesigned genome may be tested, and design failures may be detected based on identifying components that fail testing. Rules or conditions or parameters or features for the genome design may be updated accordingly, and recommendations for subsequent iterations may be provided.

Aspects of this disclosure are directed to a method for designing genomes implemented by a computing platform. The method includes receiving, as an input at a computing platform, data for a known genome and a list of alleles to be replaced in the known genome, based on the list of alleles, identifying, by the computing platform, occurrences of each allele in the known genome, removing, by the computing platform, the occurrences of each allele from the known genome, determining, by the computing platform, a plurality of allele choices with which to replace occurrences of each allele in the known genome, generating, by the computing platform, a plurality of alternative gene sequences for a genome design based on the known genome, wherein each alternative gene sequence comprises a different allele choice from the plurality of allele choices, applying, by the computing platform, a plurality of rules or conditions or parameters or features to each alternative gene sequence by assigning a score for each rule or condition or parameter or feature in each alternative gene sequence, resulting in scores for the plurality of rules or conditions or parameters or features applied to each alternative gene sequence, scoring, by the computing platform, each alternative gene sequence based on a weighted combination of the scores for the plurality of rules or conditions or parameters or features, and selecting, by the computing platform, at least one alternative gene sequence as the genome design based on the weighted scoring.

In some embodiments, the disclosed genome design method may be implemented for any type of genome, including bacterial genomes, mycoplasma genomes, yeast genomes, human genomes, genomes for any naturally-occurring organism, or genomes for any previously evolved or engineered organism. In additional embodiments, the disclosed genome design method may be implemented for designing any genomic changes, including removing any alleles, removing sites for restriction enzymes, replacing repetitive extragenic palindromic (REP) sequences with terminators, deleting non-essential genes, inserting heterologous genes to expand function, and the like.

According to some aspects, a method for updating rules in genome design is provided. The method includes introducing one or more features of a genome design into at least one cell, testing the one or more features of the at least one cell by an assay in order to identify genome viability and evaluate the phenotype of the one or more features introduced into the at least one cell, based on the testing, determining that the one or more features introduced into the at least one cell are expected to be viable or expected to fail according to one or more predefined rules or conditions or parameters or features for the genome design, and updating the predefined rules or conditions or parameters or features for genome design based on the determination. In some embodiments, the predefined rules may be updated by leveraging statistical techniques or machine learning algorithms.

Aspects of this disclosure provide a computer-implemented method for testing and modifying genome designs. The method includes obtaining all or a portion of a known genome sequence and a genome design generated by a computing platform, determining that one or more features in the genome design fail a set of predefined rules or conditions or parameters or features, predicting modifications to the genome design to satisfy a predetermined design objective and to increase probability of viability, and testing the predicted modifications to generate an improved genome design.

Additional aspects of the disclosure provide methods for identifying sequence designs when no computationally designed solution is found to be viable or confer the desired phenotype. Degenerate DNA sequences may be tested in combinations. Viable or phenotypically correct individual sequences may be identified by screening or selection. Viable DNA sequences may be used to update or learn new computational design rules or conditions or parameters or features.

The disclosure provides an engineered organism comprising a recoded genome wherein a particular sense codon at all instances within a gene or non-coding motif in a template genome is changed to alternative codons. According to one aspect, the gene is an essential gene or a non-essential gene encoding a protein sequence. According to one aspect, an instance of a particular sense codon overlaps with a non-coding motif According to one aspect, the non-coding motif is a ribosome binding site motif, an mRNA secondary structure, an internal ribosome pausing site motif or a promoter. According to one aspect, the protein sequence is preserved. According to one aspect, the non-coding motif is preserved. According to one aspect, the particular sense codon is a member selected from the group consisting of AGG, AGA, AGC, AGU, UUG, and UUA. According to one aspect, the engineered organism is *E. coli*. According to one aspect, the engineered organism is virus resistant or biocontained. According to one aspect, a cognate tRNA to the particular sense codon is eliminated from the template genome. According to one aspect, a cognate tRNA to the particular sense codon is not present in the recoded genome. According to one aspect, the particular sense codon is placed within the engineered organism and is reassigned to a non-standard amino acid. According to one aspect, the alternative codon is a synonymous codon. According to one aspect, the alternative codon is a non-synonymous codon. The present disclosure provides an engineered organism comprising a recoded genome wherein a particular sense codon at all instances within genes or non-coding motifs in a template genome are changed to alternative codons. The present disclosure provides an engineered organism comprising a recoded genome wherein a particular sense codon in a template genome is changed genome-wide to alternative codons. The present disclosure provides an engineered organism comprising a recoded genome wherein particular sense codons at all instances within an essential gene in a template genome are changed to alternative codons. The present disclosure provides an engineered organism comprising a recoded genome wherein particular sense codons at all instances within essential genes in a template genome are changed to alternative codons. The present disclosure provides an engineered organism comprising a recoded genome wherein particular sense codons in a template genome are changed genome-wide to alternative codons. The present disclosure provides an engineered organism comprising a recoded genome designed by the methods described herein. The present disclosure provides an engineered organism comprising a recoded genome wherein instances of a particular sense codon are changed to alternative codons such that the cognate tRNA to the particular sense codon can be eliminated from the engineered organism. The present disclosure provides an engineered organism comprising a recoded genome wherein instances of a particular sense codon are changed to alternative codons such that translation function of the particular sense codon can be changed. The present disclosure provides an engineered organism comprising a recoded genome wherein instances of a particular sense codon are changed to alternative codons such that translation function of the particular sense codon can be eliminated.

Further features and advantages of certain embodiments of the present disclosure will become more fully apparent in the following description of embodiments and drawings thereof, and from the claims.

BRIEF DESCRIPTION OF THE DRAWINGS

The foregoing and other features and advantages of the present embodiments will be more fully understood from the following detailed description of illustrative embodiments taken in conjunction with the accompanying drawings in which.

FIG. 5A illustrates the entire recoded genome divided into 87 segments of ~50-kb. Codons AGA, AGG, AGC, AGU, UUA, UUG, and UAG were computationally replaced by synonymous alternatives (center). Other codons (e.g. UGC) remain unchanged. Color-coded histograms represent the abundance of the seven forbidden codons in each segment. FIG. 5B illustrates codon frequencies in non-recoded (wt; *E. coli* MDS42) versus recoded (rc) genome. Forbidden codons are colored. FIG. 5C illustrates the scale of DNA editing in genomes constructed by de novo synthesis. Plot area represents DNA editing as the number of modified bp compared to the parent genome. Dark gray represents percent of genome (63%) validated in vivo. Wt, wild-type.

FIG. 6 illustrates a genealogy of recoded *E. coli* strains, including the lineage of genome-recoded *E. coli* strains and their computational and biological parents. Commonly used laboratory strains are shown in green. Non-*E. coli* strain from which orthogonal tRNA was imported is shown in brown. Previously published recoded strains are shown in blue. Strains constructed in the current study are shown in black. The final rE. coli-57 and its bio-contained counterpart rE. coli-57C are shown in gray. (aaRS=aminoacyl-tRNA synthetase).

FIG. 8 illustrates an overview of the computational pipeline for recoded genome design. The software accepts as input a genome template (GenBank file) and a list of codons to be replaced. User-defined rules, both biological and technical (A-G), are then applied to generate a new recoded genome (Genbank file). Synthesis-compatible 2-4 kb sequences are generated. Rules A-G are schematized in FIGS. 9A-9G and further explained in Tables 1-2.

FIGS. 9A-9G illustrate rules or conditions or parameters or features or guidelines for computational design. FIG. 9A discloses SEQ ID NOS 2263-2265, 2264, 2266-2267, 2270, 2268-2270, respectively, in order of appearance. FIG. 9B discloses SEQ ID NOS 2271-2273, and 2272, respectively, in order of appearance. FIG. 9D discloses SEQ ID NOS 2274-2276, and 2275, respectively, in order of appearance. FIG. 9E discloses SEQ ID NOS 2277-2279, and 2278, respectively, in order of appearance.

FIG. 10A illustrates a pipeline schematic comprising 1) computational design of a 57-codon genome; 2) de novo synthesis of 2 to 4-kb overlapping recoding fragments; 3) assembly of 50-kb segment in S. cerevisiae (orange) on a low copy plasmid; 4) plasmid electroporation in E. coli (wt.seg—non-recoded chromosomal segment); 5) chromosomal sequence corresponding to recoded segment (e.g., wt.seg) replaced by kanamycin cassette (Kan), such that cell viability depends solely on expression of recoded genes; 6) λ-integrase-mediated recombination of attP and attB sequences (P—episomal, B—chromosomal); 6a,b) elimination of residual vectors (see (FIG. 10C)); 7) single-copy integrated recoded segment. attL-attR sites shown in gray. FIG. 10B illustrates PCR analysis of steps 4-7. (Lanes: "L"—GeneRuler 1-kb plus ladder; "C"—control Top10; numbers 4-7 correspond to schematics in FIG. 10A). Red arrows denote PCR primers. FIG. 10C illustrates Cas9-mediated vector elimination, in which residual vector carrying recoded segment is targeted for digestion by Cas9 using attP-specific guide RNA (gRNA). In 6a) additional copies of the recoded segment carry intact attP sequence; 6b) shows Cas9 targeting of attP sequence to eliminate additional vector copies. The integrated segment is not cut since it does not contain an attP sequence. All steps were confirmed by PCR analysis. "gRNA"—guide-RNA.

In FIG. 12A, recoded segments were episomally expressed in the absence of corresponding wild-type genes. Doubling time is shown relative to the non-recoded parent strain, FIG. 12B illustrates localization of fitness impairment in segment 21, Chromosomal genes (gray) were deleted to test for complementation by recoded genes (orange). Decrease in doubling time was observed upon deletion of rpmF-accC operon. Essential genes in FIG. 12B are framed. In FIG. 12C, fine-tuning of rpmF-accC operon promoter resulted in increased gene expression and decrease in doubling time. (Orange: Initial promoter. Green: Improved promoter). FIG. 12D illustrates RNA-Seq analysis of 208 recoded genes (blue, segments 21, 38, 44, 46, 70). (Wt gene expression shown in gray. Differentially expressed recoded genes shown in red (absolute log 2 fold-change>2, adjusted p-value<0.01). Inset. P-value distribution of recoded genes).

FIG. 13A illustrates measurements of doubling time before and after removal of the wild-type chromosomal sequence in strains carrying a recoded segment on low copy plasmid (see steps 4 and 5 in FIG. 10A). FIG. 13B illustrates measurements of doubling time before and after removal of the wild-type sequence, and after chromosomal integration (see steps 4, 5, 6 and 7 in FIG. 10A). Relative Doubling time-fold change between modified and parental strain (i.e. intact genome and no recoded segments).

FIG. 14A shows expression levels for recoded (green) and non-recoded (purple) genes. FIG. 14B shows p-value and fold changes for all recoded genes. None of the genes in segment 43 was found to be significantly differentially expressed (i.e absolute log 2 fold-change>2 and adjusted p-value<0.01).

In FIG. 15A, recoded segment 44 (orange) did not support cell viability upon complete deletion of chromosomal sequence (Chr-Δseg44.0). The causative recoded gene (accD) was identified by successive chromosomal deletions (Chr-Δseg44.1-4. 'X'—nonviable). Essential genes are framed. In FIG. 15B, λ-recombination was used to exchange lethal accD sequence (accD.Initial, recoded codons in orange) with an alternative recoded accD sequence (accD.Improved, alternative codons in blue). mRNA structure and RBS motif strength were calculated for both sequences. Wt shown in gray. 'accD nuc': the first position in each recoded codon. The resulting viable sequence (accD. Viable) carried codons from both designs. mRNA and RBS scores—ratio between predicted mRNA folding energy (kcal/mol) (Markham et al., 2005) or predicted RBS strength (Salis, 2011) of recoded and non-recoded codon.

FIG. 17 illustrates an example of sequence alignment of the different versions of the gene accD in segment 44. WT corresponds to non-recoded sequence. accD.Initial corresponds to lethal recoded design. accD.Improved corresponds to recoded accD sequence generated by an improved algorithm. accD.Viable corresponds to the genotype of the viable clones obtained after recombineering of accD.Improved to replace accD.Initial.

FIG. 18A illustrates bio-contained strains modified with 57-codon adk maintained similar fitness as their nonmodified parents. Light gray—non modified biocontainment strains (Mandell et al., 2015); Dark gray—biocontained strains with 57-codon adk. FIG. 18B illustrates escape rate of bio-contained strains with or without 57-codon adk. SC media: SDS+Chloramphenicol. SCA media: SDS+Chloramphenicol+Arabinose.

FIG. 19A illustrates an example workflow used to create and analyze strain C123. The design phase involved identification of 123 AGR codons in the essential genes of Escherichia coli. MAGE oligos were designed to replace all instances of these AGR codons with the synonymous CGU codon. The build phase used CoS-MAGE to convert 110 AGR codon to CGU. Multiplex allele specific colony PCR (MASC-PCR) was used to screen for desired recombinants. AGR conversions that were not observed in 96 clones screened by MASC-PSC were triaged to troubleshooting. The in vivo troubleshooting phase resolved the 13 codons that could not be readily converted to CGU. In the Study Phase, sequencing, evolution and phenotyping was performed on strain C123. FIG. 19B illustrates an example schematic of the C123 genome relative to MG1655 (Chr. 0 oriented up). Exterior labels indicate the set groupings of AGR codons. Successful AGR to CGU conversions are indicated by radial green lines, and 13 recalcitrant codons are indicated by radial red lines.

FIGS. 20A-2B illustrate an example analysis of attempted AGR→CGU replacements. FIG. 20A illustrates AGR recombination frequency versus normalized ORF position. AGR recombination frequency was determined 96 clones per cell population using MASC-PCR. Normalized ORF position was the residue number of the AGR codon divided by the total length of the ORF. Failed AGR to CGU conversions are indicated using vertical red lines below the x-axis.

FIG. 21A illustrates genes ftsI and murE overlap with each other. An AGA→CGU mutation in ftsI would introduce a non-conservative Asp3Val mutation in murE. The amino acid sequence of murE was preserved by using an AGA→CGA mutation. FIG. 21A discloses SEQ ID NOS 2280-2285, and 2284, respectively, in order of appearance. FIG. 21B illustrates gene secE overlaps with the RBS for downstream essential gene nmsG. An AGG→CGU mutation is predicted to diminish the RBS strength by 97% (47). RBS strength is preserved by using an AGG→GAG mutation. FIG. 21B discloses SEQ ID NOS 2286-2289, 2289, and 2290, respectively, in order of appearance. FIG. 21C illustrates that gene ssb has an internal RBS-like motif shortly after its start codon. An AGG→CGU mutation would diminish the RBS strength by 94%. RBS strength is preserved by using an AGA→CGA mutation combined with additional wobble mutations indicated in green letters. FIG. 21C discloses SEQ ID NOS 2291-2294, respectively, in order of appearance. FIG. 21D illustrates that gene rnpA has a defined mRNA structure that would be changed by an AGG→CGU mutation. The original RNA structure is preserved by using an AGG→CGG mutation. The RBS (green), start codon (blue) and AGR codon (red) are annotated with like-colored boxes on the predicted RNA secondary structures. FIG. 21D discloses SEQ ID NOS 2295-2298, respectively, in order of appearance.

FIG. 22 illustrates a scatter plot showing predicted RBS strength (y-axis, calculated with the Salis ribosome binding site calculator (47)) versus deviations in mRNA folding (x-axis, calculated at 37° C. by UNAFold Calculator (41)). Small gray dots represent non-essential genes in E. coli MG1655 that have an AGR codon within the first 10 or last 10 codons. Large gray dots represent successful AGR→CGU conversions in the first 10 or last 10 codons of essential genes. Orange asterisks represent unsuccessful AGR→CGU mutations (recalcitrant codons) in essential genes. Green dots represent optimized solutions for these recalcitrant codons. The "safe replacement zone" (blue shaded region) is an empirically defined range of mRNA folding and RBS strength deviations, based on the successful AGR→CGU replacement mutations observed in this study. Most unsuccessful AGR→CGU mutations (Orange asterisks) cause large deviations in RBS strength or mRNA structure that are outside the "safe replacement zone." Genes holB and ftsI are two notable exceptions because their initial CGU mutations caused amino acid changes in overlapping essential genes. Arrows show that deviations in RBS strength and/or mRNA structure are reduced for four examples of optimized replacement of recalcitrant codons (ftsA, folC, rupA, rpsJ).

FIG. 24 shows a scatter plot showing the results of the CRAM experiment (FIG. 23) Each panel represents a different gene. The Y-axis represents RBS strength deviation (calculated with the Salis ribosome binding site calculator (Salis, 2011)) while the X-axis shows deviations in mRNA folding energy (x-axis, calculated at 37° C. by UNAFold Calculator (Zadeh et al., 2011). Codon abundance at the intermediate time point (t=72 hrs, chosen to show maximal diversity after selection) is represented by the dot size. Green dots represent the WT codon. Blue dots represent synonymous AGR codons. Orange dots represent the remaining 58 non-synonymous codons, which may introduce non-viable amino acid substitutions. Black squares represent unsuccessful AGR→CGU conversions observed in the genome-wide recoding effort (Table 3, FIG. 19A-19B). The "safe replacement zone" (blue shaded region) is the empirically defined range of mRNA folding and RBS strength deviations, based on the successful AGR→CGU replacement mutations observed in this study (FIG. 21A-D). Genes bcsB and chpS are non-essential in examples of strains described and thus serve as controls for AGR codons that are not under essential gene pressure.

FIGS. 25A-25B illustrate an example in which predicting optimal replacements for AGR codons reduces the number of predicted codons that require troubleshooting. FIG. 25A illustrates empirical data from the construction of C123. 110 AGR codons were successfully recoded to CGU (green), and 13 recalcitrant AGR codons required troubleshooting (red, striped). FIG. 25B illustrates predicted recalcitrant codons for replacing all instances of the AGR codons genome-wide. The reference genome used for this analysis had insertion elements and prophages removed (Umenhoffer et al., 2010) to limit total nucleotides synthesized, leaving 3181 AGR codons to be replaced. The analysis predicts that replacing all instances of AGR with CGU would have resulted in 246 failed conversions ('Naïve Replacement', red striped). However, implementing the rules from this work ('Informed Replacement') to identify the best CGN alternative reduces the predicted failure rate from 10.5% (13/123), to 2.32% (74/3181) of which only a small subset will have a direct impact on fitness due to their location in non-essential genes. Each specific synonymous CGN is identified with a unique shade of green and is labeled inside of its respective section.

FIGS. 27A-27C illustrate an example schematic of 3 different failures cases for recalcitrant AGR→CGU mutations. For each case, the top row is the initial sequence, the middle row is the AGR→CGU mutation and the third row of primary DNA sequence is the optimized solution converged on in troubleshooting. Green boxes below the DNA sequence indicates amino acid sequence in the same order (top is initial, middle results from AGR→CGU, bottom results from troubleshoot solution). FIG. 27A illustrates C-terminal overlap cases of AGR's at ends of essential genes with downstream ORF's. (i) Genes ftsI and murE overlap with each other. An AGA→CGU mutation in ftsI would introduce a non-conservative Asp3Val mutation in murE. The amino acid sequence of murE was preserved by using an AGA→CGA mutation. FIG. 27A (i) discloses SEQ ID NOS 2280-2285, and 2284, respectively, in order of appearance. (ii) Genes holB and tmk overlap with each other. An AGA→CGU mutation in holB would introduce a non-conservative Stop214Cys mutation in tmk. The amino acid sequence of tmk was preserved by using an AGA→CGC mutation and adding 3 nucleotides. FIG. 27A (ii) discloses SEQ ID NOS 2299-2302, respectively, in order of appearance. FIG. 27B illustrates C-terminal overlap cases of AGR's at ends of essential genes with the RBS of a downstream gene. (i) Gene secE overlaps with the RBS for downstream essential gene nusG. An AGG→CGU mutation would diminish the RBS strength by 97% (Salis et al., 2011). RBS strength is preserved by using an AGG→GAG mutation. FIG. 27B (i) discloses SEQ ID NOS 2286-2289, 2289, and 2290, respectively, in order of appearance. (ii) Gene dnaT overlaps with the RBS for downstream essential gene dnaC. An AGG→CGU mutation would diminish the RBS strength by 77% (Salis et al., 2011). RBS strength is preserved by using an AGG→CGA mutation. FIG. 27B (ii) discloses SEQ ID NOS 2303-2305, respectively, in order of appearance. (ii) Gene folC overlaps with the RBS for downstream gene dedD, shown to be essential in the strain. An AGGAGA→CGUCGU mutation would diminish the RBS strength by 99% (Salis et al., 2011). RBS strength is preserved by using an AGG→CGGCGA mutation. FIG. 27B (iii) discloses SEQ ID NOS 2306-2311, and 2312 respectively, in order of appearance. FIG. 27C illustrates N-terminal RBS motifs causing recalcitrant AGR conversions at the beginning of essential genes. (i) Gene dnaT has an internal RBS-like motif. An AGG→CGU mutation would increase the RBS strength 26 times (Salis, 2011). RBS strength is better preserved by using an AGA→CGU mutation combined with additional wobble mutations. FIG. 27C (i) discloses SEQ ID NOS 2313-2316, 2316, and 2316, respectively, in order of appearance. (ii) Gene prfB has an internal RBS-like motif. This RBS motif is involved in a downstream planned frameshift in prfB (Curan, 1993). Only by removing the frameshift was AGG→CGU mutation possible (leaving a poor RBS-like site). To maintain the frameshift, AGG→CGG mutation and additional wobble was required. In that case, local RBS strength was maintained (fourth row). FIG. 27C (ii) discloses SEQ ID NOS 2317-2322, 2321, and 2321, respectively, in order of appearance. (iii) Gene ssb has an internal RBS-like motif. An AGG→CGU mutation would diminish the RBS strength by 94%. RBS strength is preserved by using an AGA→CGA mutation combined with additional wobble mutations. FIG. 27C (iii) discloses SEQ ID NOS 2291-2294, respectively, in order of appearance.

FIG. 30A illustrates the wild-type rnpA sequence, with AGG (in blue box). FIG. 30B illustrates the wild-type rnpA sequence with AGG→CGU in blue box (not observed). FIG. 30C illustrates the wild-type rnpA sequence with AGG→CGG in blue box (observed with no growth rate defect). FIG. 30D illustrates the wild-type rnpA sequence with AGG→CTG in blue box and one complementary mutation CCC→CCA to maintain the mRNA loop (in blue box) (observed, also with no growth rate defect).

DETAILED DESCRIPTION

Figure 1:
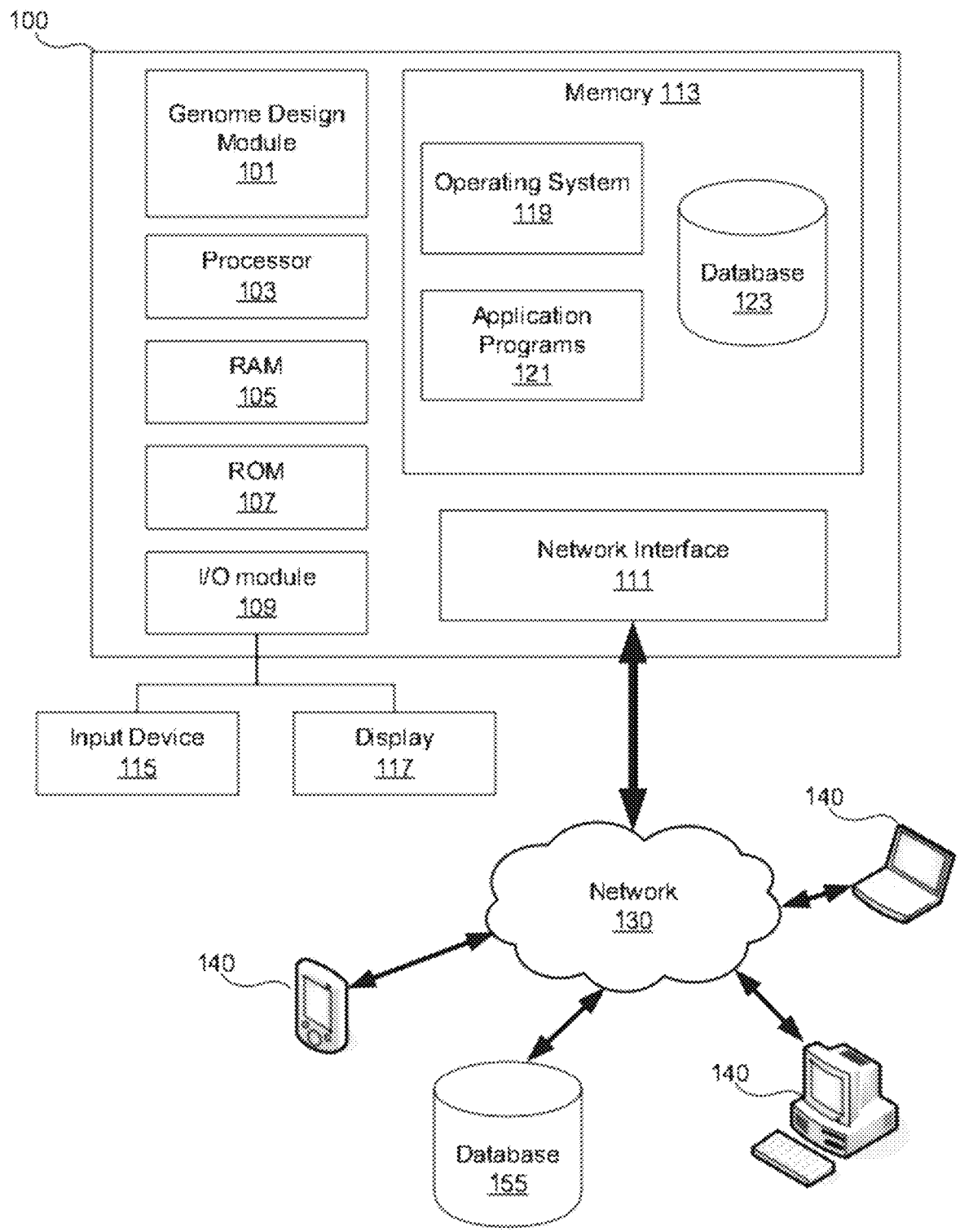
FIG. 1 illustrates a block diagram of an example computing device that may be utilized to execute software in accordance with one or more example embodiments.

Embodiments of the present disclosure are based on methods, algorithms, and computer software for designing genomes based on a set of rules or constraints or conditions or parameters or features which may be generally referred to throughout as "constraints", "a constraint," "rules," or "a rule" or "ruled based." The rule-based genome design described herein includes methods and computer algorithms for implementing genome modifications while preserving known biological motifs and features in DNA and satisfying various constraints and/or rules or conditions or parameters or features for synthesis and assembly of designed genomes. As described herein, rules or conditions or parameters or features may refer to biological constraints and synthesis constraints which may be applied in synthesizing genome designs by scoring each constraint for a possible genome design. Biological motifs may include essential genes, ribosome binding site (RBS) motifs, mRNA secondary structures, internal ribosome pausing site motifs, and the like. In some embodiments, the disclosed methods for genome design may be directed to designing genetic elements, including genes, operons, genomes, and the like.

Aspects of the present disclosure include methods for empirically deriving new rules or constraints or conditions or parameters or features based on combinations of multiplex automatable genome engineering (MAGE) and targeted sequencing, along with other technologies such as CRISPR-assisted MAGE (CRAM), MAGE in combination with molecular inversion probes (MIPS), and the like. Aspects described herein may also include providing information about designed genomes based on a set of constraints and/or rules and recommending modifications that may yield phenotypic improvements in future genome design. Ultimately, the rule-based genome design methods and integrated software disclosed herein may be beneficial in the fields of genome engineering and bioproduction for improving efficiency and reducing costs of DNA construct production.

In some cases, several challenges may arise when modifying a genome, such as when choosing synonymous alleles for genome-wide allele replacement of certain alleles (which may be referred to as "forbidden alleles" or "forbidden codons" as described herein). First, to ensure biological viability, it may be important to maintain the fundamental features of a parent genome, such as GC content and regulatory elements encoded by the primary nucleotide sequence. Additionally, when forbidden alleles fall in overlapping gene regions, it may be necessary to carefully split these overlaps in a manner that avoids introducing non-synonymous mutations or disrupting regulatory features. Finally, it may be desirable for a computational design scheme to be compatible with the experimental tools being used for genome construction.

Thus, described herein is a rule-based architecture for genome recoding software, in which user-specified rules serve as constraints for finding suitable synonymous allele replacements. As an example, Tables 1 and 2 provide further examples of rules and constraints that may be implemented for genome design (e.g., for design and synthesis of a radically recoded E. coli genome). In particular, Table 1 provides examples of biological constraints or conditions or parameters or features for genome design rules, whereas Table 2 provides examples of synthesis constraints or conditions or parameters or features for genome design rules. The rule-based architecture described herein may be implemented as a computer module or software module and may be extended to general applications, as well as customized according to specific needs.

In the following description of the various embodiments, reference is made to the accompanying drawings, which form a part hereof, and in which is shown by way of illustration, various embodiments of the disclosure that may be practiced. It is to be understood that other embodiments may be utilized. A person of ordinary skill in the art after reading the following disclosure will appreciate that the various aspects described herein may be embodied as a computerized method, system, device, or apparatus utilizing one or more computer program products. Accordingly, various aspects of the computerized methods, systems, devices, and apparatuses may take the form of an embodiment consisting entirely of hardware, an embodiment consisting entirely of software, or an embodiment combining software and hardware aspects. Furthermore, various aspects of the computerized methods, systems, devices, and apparatuses may take the form of a computer program product stored by one or more non-transitory computer-readable storage media having computer-readable program code, or instructions, embodied in or on the storage media. Any suitable computer readable storage media may be utilized, including hard disks, CD-ROMs, optical storage devices, magnetic storage devices, and/or any combination thereof. In addition, various signals representing data or events as described herein may be transferred between a source and a destination in the form of electromagnetic waves traveling through signal-conducting media such as metal wires, optical fibers, and/or wireless transmission media (e.g., air and/or space). It is noted that various connections between elements are discussed in the following description. It is noted that these connections are general and, unless specified otherwise, may be direct or indirect, wired or wireless, and that the specification is not intended to be limiting in this respect.

In one or more arrangements, teachings of the present disclosure may be implemented with a computing device. FIG. 1 illustrates a block diagram of a computing device 100 that may be used in accordance with aspects of the present disclosure, such as for implementing methods for genome design. The computing device 100 is a specialized computing device programmed and/or configured to perform and carry out aspects associated with rule-based genome design as described herein. The computing device 100 may have a genome design module 101 configured to perform methods and execute instructions as described herein. The genome design module 101 may be implemented with one or more specially configured processors and one or more storage units (e.g., databases, RAM, ROM, and other computer-readable media), one or more application specific integrated circuits (ASICs), and/or other hardware components. Throughout this disclosure, the genome design module 101 may refer to the software (e.g., a computer program, application, and or algorithm) and/or hardware used to receive one or more genome files or templates (e.g., one or more annotated GenBank files), receive a list of alleles to be replaced, modify a genome by applying a set of biological constraints and synthesis constraints to the genome sequences(s), generate a new genome design based on the modifications, scoring genome designs, modifying and/or creating new rules or constraints or conditions or parameters or features for genome design, and the like. Specifically, the genome design module 101 may be a part of a rule-based architecture for genome recoding software which may be further extended to other applications. The one or more specially configured processors of the genome design module 101 may operate in addition to or in conjunction with another general processor 103 of the computing device 100. In some embodiments, the genome design module 101 may be a software module executed by one or more general processors 103. Both the genome design module 101 and the general processor 103 may be capable of controlling operations of the computing device 100 and its associated components, including RAM 105, ROM 107, an input/output (I/O) module 109, a network interface 111, and memory 113.

The I/O module 109 may be configured to be connected to an input device 115, such as a microphone, keypad, keyboard, touchscreen, gesture or other sensors, and/or stylus through which a user of the computing device 100 may provide input data. The I/O module 109 may also be configured to be connected to a display device 117, such as a monitor, television, touchscreen, and the like, and may include a graphics card. The display device 117 and input device 115 are shown as separate elements from the computing device 100, however, they may be within the same structure. Using the input device 115, system administrators or users may add and/or update various aspects of the genome design module, such as rules or constraints or conditions or parameters or features, scoring, predefined thresholds, ranges, and biological and synthesis constraints related to designing a genome. The input device 115 may also be operated by users in order to design a genome by inputting a genome file and a list of alleles or sequences to be modified in the genome file by the genome design module 101.

The memory 113 may be any computer readable medium for storing computer executable instructions (e.g., software). The instructions stored within memory 113 may enable the computing device 100 to perform various functions. For example, memory 113 may store software used by the computing device 100, such as an operating system 119 and application programs 121, and may include an associated database 123.

The network interface 111 allows the computing device 100 to connect to and communicate with a network 130. The network 130 may be any type of network, including a local area network (LAN) and/or a wide area network (WAN), such as the Internet. Through the network 130, the computing device 100 may communicate with one or more computing devices 140, such as laptops, notebooks, smartphones, personal computers, servers, and the like. The computing devices 140 may include at least some of the same components as computing device 100. In some embodiments the computing device 100 may be connected to the computing devices 140 to form a "cloud" computing environment.

The network interface 111 may connect to the network 130 via communication lines, such as coaxial cable, fiber optic cable, and the like or wirelessly using a cellular backhaul or a wireless standard, such as IEEE 802.11, IEEE 802.15, IEEE 802.16, and the like. In some embodiments, the network interface may include a modem. Further, the network interface 111 may use various protocols, including TCP/IP, Ethernet, File Transfer Protocol (FTP), Hypertext Transfer Protocol (HTTP), and the like, to communicate with other computing devices 140.

According to certain aspects, the computing device 100 may interface with one or more databases 155 to access genome data (e.g., gene sequences). For example, a database 155 may be an external database that stores a collection of nucleotide sequences (e.g., DNA, mRNA, cDNA, and the like) and corresponding protein translations (e.g., GenBank). In some cases, the genome design module 101 may access and/or receive a specific genome file or template from the database 155, and the genome design module 101 may utilize the file for further genome design based on a set of rules and scoring.

FIG. 1 is an example embodiment of a computing device 100. In other embodiments, the computing device 100 may include fewer or more elements. For example, the computing device 100 may use the general processor(s) 103 to perform functions of the genome design module 101, and thus, might not include a separate processor or hardware for the genome design module 101.

Although not required, various aspects described herein may be embodied as a method, data processing system, or as computer-readable medium storing computer-executable instructions. For example, a computer-readable medium storing instructions to cause a processor to perform steps of a method in accordance with aspects of the disclosed embodiments is contemplated. For example, aspects of the method steps and algorithms disclosed herein may be executed on a processor on computing device 100. Such a processor may execute computer-executable instructions stored on a computer-readable medium.

Figure 2:
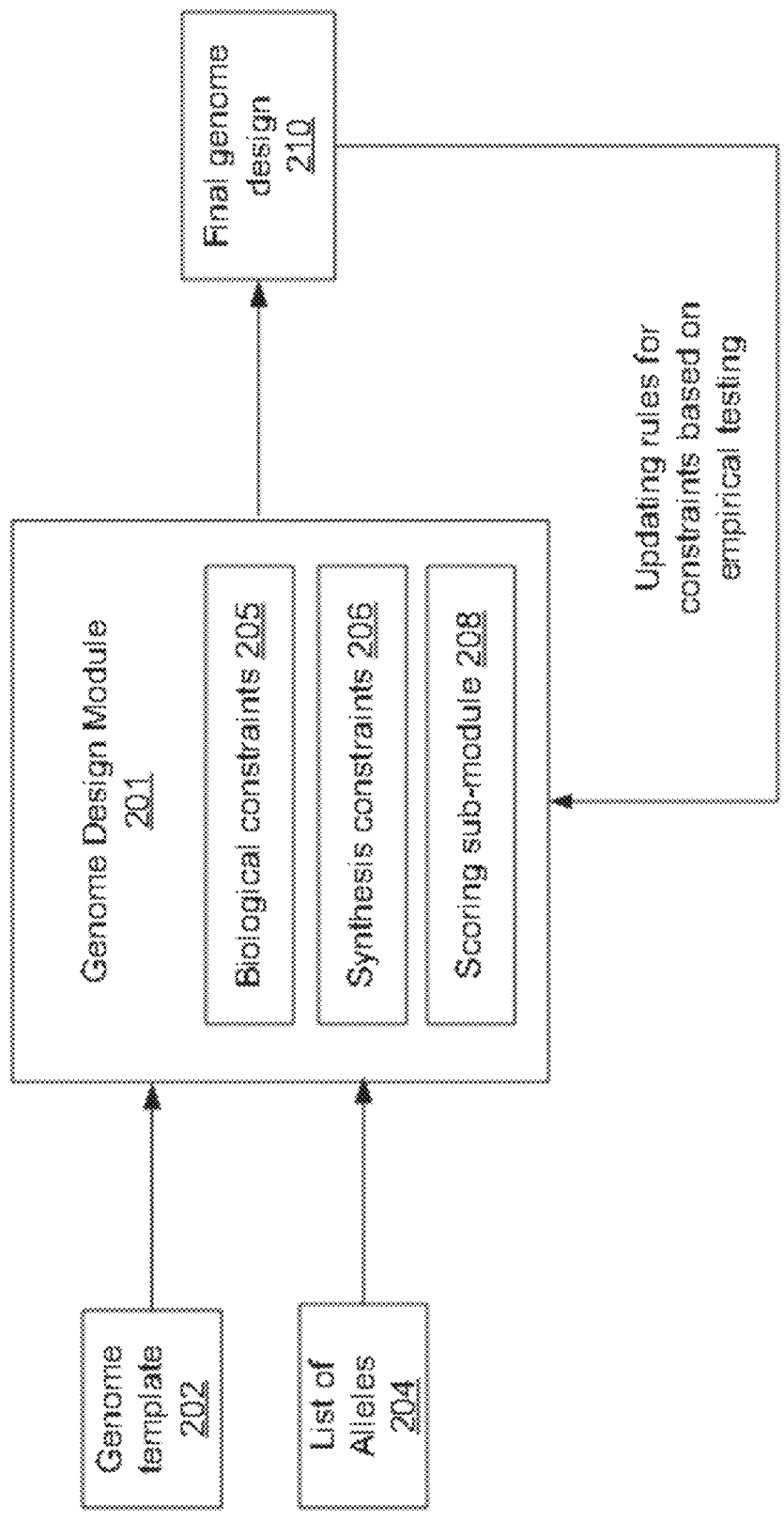
FIG. 2 illustrates an example block diagram of a genome design module in which various aspects of the present disclosure may be implemented in accordance with one or more example embodiments.

FIG. 2 illustrates an example block diagram of a genome design module in which various aspects of the present disclosure may be implemented in accordance with one or more example embodiments. In particular, FIG. 2 illustrates a genome design module 201 which may comprise a software tool that may be utilized for any genome modifications, such as a genome-wide allele replacement in a prokaryotic genome. In some embodiments, the genome design module 201 may be the same as the genome design module 101.

The genome design module 201 may utilized for a variety of purposes, including refactoring genomes such as by removing all occurrences of a particular allele throughout the genome (allowing deletion of translation factors and functional allele reassignment), rearranging operons into functionally related units, removing non-essential elements (e.g., cryptic prophages, mobile elements, non-essential genes, etc.), modifying/optimizing/introducing metabolic pathways, and the like.

As illustrated in the example in FIG. 2, the genome design module 201 may receive two inputs: a genome template file 202 and a list of alleles 204. The genome template 202 may comprise known genome sequences or a particular genome (e.g., in the form of an annotated GenBank file). In some embodiments, the genome template 202 may comprise sequences for any type of genome, including bacterial genomes, mycoplasma genomes, yeast genomes, human genomes, genomes for any naturally-occurring organism, or genomes of any previously evolved or engineered organism. As an example, an *E. coli* MDS42 genome template (GenBank: AP012306.1) was used as the genome template 202 as described in the Examples herein. The list of alleles 204 may comprise a list of alleles to be synonymously replaced throughout the genome. The list of alleles 204 may also include coding sequences (e.g., codons) and non-coding sequences (e.g., non-coding RNAs including tRNA and sRNA, extragenic sequence motifs that may or may not overlap with the coding sequence, repetitive extragenic palindromic (REP) sequences, or the like). In some embodiments, the list of alleles 204 may represent a list of codons, which may be referred to as "forbidden codons." For example, the following seven codons were in the list of codons to be replaced in the *E. coli* example described below: AGA, AGG, AGC, AGU, UUG, UUA, and UAG.

The genome design module 201 may receive the genome template 202 and the list of alleles 204 and automatically replace all instances of alleles from the list in the genome. For example, the genome design module 201 may automatically replace, within the genome, all instances of forbidden codons from a list of codons. The genome design module 201 may also utilize a scoring sub-module 208, and the genome design module 201 may be configured to select synonymous codons that allow the resulting sequence to best adhere to biological constraints 205 and/or synthesis constraints 206. In some embodiments, the scoring sub-module 208 may be referred to as a scoring tool.

Tables 1 and 2 provide examples of biological constraints 205 and synthesis constraints 206, respectively, which may be applied in genome design, along with descriptions of rules, constraints or conditions or parameters or features, motivation, implementation, and corresponding genome annotations. The synthesis constraints 206 may include one or more experimental rules or constraints or conditions or parameters or features that may be applied for synthesizing genome designs. In some cases, the synthesis constraints 206 may be vendor and/or technology-specific rules or constraints or conditions or parameters or features that are to be satisfied during genome design. Examples of synthesis constraints 206 may include (and are not limited to) rules for removing forbidden restriction enzyme motifs, leveraging synonymous swaps to normalize high/low GC content within genes in a genome design, preserving regulatory motifs if high/low GC content is present in intergenic regions, minimizing strong secondary structures, deleting repetitive elements which may be difficult to synthesize and replacing them by terminators, leveraging synonymous swaps to diversify primary sequence if homopolymer runs are present within genes, preserving regulatory motifs if homopolymer runs are present in intergenic regions, partitioning operons to increase the likelihood of synthesizing modular genome units that contain entirety of discrete transcriptional units, etc.

The biological constraints 205 may include one or more rules or constraints or conditions or parameters or features that are applied to genome design for preserving biologically relevant motifs, in which the biological constraints 205 may be implemented as code in the genome design module 201. For example, the biological constraints 205 may include a rule for maintaining predicted secondary structure of RNA (e.g., including, but not limited to, mRNA). The genome design module 201 may compute a predicted RNA secondary structure for both an original sequence and a modified, design sequence, and the scoring sub-module 208 may provide a quantitative representation of the difference between the two. In some embodiments, the genome design module 201 may compute deviation in predicted mRNA secondary structure by comparing the predicted free energy ($\Delta G$) of the original and designed sequences (e.g., a thermodynamic-based secondary structure prediction) and/or by calculating a number of nucleotides that are no longer paired with the same sister nucleotide in the designed sequence with respect to the original sequence. In some cases, a rule may be modified according to the context of a desired change. For example, for changes near a 5' end of a gene, the genome design module 201 may compute an mRNA secondary structure spanning nucleotides −30 to +100 of a sequence and relative to the start codon of the gene.

Additionally, the biological constraints 205 may also include a rule or constraint or condition or parameter or feature for preserving ribosome binding site (RBS) motifs. A ribosome binding site may comprise a DNA sequence motif (e.g., sequence of nucleotides) found approximately ten bases upstream of a gene (e.g., upstream of a start codon). The genome design module 201 may score and rank sequence designs according to disruption to ribosome binding sites (e.g., by using the scoring sub-module 208). For example, if a RBS motif exists in overlapping genes (e.g., to support expression of a downstream, overlapping gene), it may be beneficial to only allow mutations that do not strongly impact RBS strength. In yet another example, if output design parameters conflict with preserving said RBS motif in an overlapped architecture, then coding regions may be split and an RBS motif of similar strength may be inserted to support translation of downstream genes.

In some embodiments, the genome design module 201 may implement RBS motif strength predictions by utilizing biophysical models, such as the Salis ribosome binding site calculator (Salis, 2011), or by other empirical RBS strength look-up tables. For example, the scoring sub-module 208 of the genome design module 201 may calculate a predicted expression score for the reference sequence and the designed sequence using a biophysical model (e.g., from Salis, 2001). The ratio (or log-ratio) of these scores may become a quantified expression of disruption of this rule or constraint or conditions or parameter or feature.

In yet another example, the biological constraints 205 may include a rule or constraint or condition or parameter or feature for preserving internal ribosome pausing site motifs. For example, the occurrence of ribosome binding site-like motifs (e.g., an anti-Shine-Dalgarno sequence) may correspond to translational pausing in *E. coli*, which may suggest that these motifs comprise a biologically important role (Li et al., 2012). Thus, the genome design module 201 may implement a design rule that leverages a biophysical model (e.g., from Salis, 2001). As described in the Examples herein, to score a proposed design change, it may be assumed that a codon might be part of an RBS by inserting a phantom ATG start codon the correct number of bases (e.g., approximately 10) downstream of the change. Based on this rule, the genome design module 201 may calculate the predicted RBS strength before and after a proposed design change, penalizing disruption of existing internal ribosome pausing sites, or introduction of strong internal ribosomal pausing sites where one did not exist before.

Additional examples of biological constraints 205 may include (and are not limited to) rules or constraints or conditions or parameters or features for ensuring that a selection of alternative alleles or codons is consistent with global distribution of allele or codon choice (both for recoding and heterologous expression), preserving known sequence motifs in a genome design (e.g., frame-shift, selenocysteine insertion sequence (SECIS) sites, recombination sites, etc.), preserving regulatory motifs such as by preserving/tuning promoter, enhancer, and/or transcription factor motifs, applying phylogenetic conservation for a genome design by choosing sequences which are closest to phylogenetically-related neighbors when considering alternatives for a genome design modification, reducing homology between redesigned regions through non-disruptive muddling, etc. In the reducing homology example, the optimal solution for performing synonymous codon swaps while preserving an overlapping regulatory motif may be to split the overlap by making a copy, which may result in adjacent regions of high homology. The homology may be broken by performing synonymous codon swaps or other changes that do not break any annotated regulatory motifs. This may be important to produce stable genomes, such as by preventing an undesired recombination that could revert the redesigned sequence.

Furthermore, the genome design module 201 may implement the rules or constraints or conditions or parameters or features of the biological constraints 205 by using the scoring sub-module 208 to score genetic sequences (e.g., genome designs) with respect to reference sequences (e.g., genome templates). In some embodiments, the scoring sub-module 208 may assign a quantitative score to every possible change to a gene or genome. This scoring may allow ranking and prioritizing designs that achieve a desired genotypic or phenotypic outcome. The scoring, ranking, and prioritization features may comprise core features of the software for the genome design module 201.

For example, for a design choice with mutually exclusive options (e.g., for choosing an allele replacement), the genome design module 201 may allow ranking of design choices. In some embodiments, the best single design choice or any number of the best single design choices may be chosen for synthesis and testing. In other embodiments, all design choices that pass a predefined score threshold may be synthesized and tested.

Additionally, the scoring sub-module 208 of the genome design module 201 may implement different types of scoring. For example, a higher score may indicate less deviation from the biological constraints 205 (e.g., a set of rules) and may thus be preferred. For example, less deviation from the constraints may indicate a higher predicted success in biological validation. In another example, a lower score may indicate less deviation from the biological constraints 205 (e.g., a set of rules), and may thus be preferred.

The genome design module 201 may further implement scoring for a genetic design as a weighted combination of scores from specific rules or constraints or conditions or parameters or features. For example, in the case where a score may be interpreted as a deviation from a biological motif value and for the genetic design of swapping alternative alleles, each choice of allele may be scored according to a combination of factors.

That is, there may be a plurality of alternative gene sequences in which each alternative gene sequence comprises a different allele choice which may be used to replace one or more forbidden alleles in a reference genome. Thus, the genome design module 201 may apply rules or constraints or conditions or parameters or features for the biological constraints 205 by assigning a score for each rule in each alternative gene sequence. In some embodiments, each allele choice may be scored according to a combination of biological constraints 205, including fold disruption of predicted mRNA secondary structure folding energy, fold disruption of predicted ribosome binding site (RBS) affinity strength, and the like.

For example, a total score for an alternative gene sequence comprising an allele choice may be computed (e.g., by the genome design module 201) using the following equation:

$$\text{score} = w_1 * f(\text{mRNA score}) \times w_2 * g(\text{RBS score})$$

In the above equation, $w_1$ and $w_2$ represent weights, whereas f and g represent functions of the respective quantification of the rules. Furthermore, the weights $w_1$ and $w_2$ may be determined empirically and may be updated or modified according results from synthesizing and testing genome designs. In other embodiments, the weights may be adjusted by manual specification in which a user may manually specify (e.g., enter in) each weight (e.g., as an input into the genome design module 201 and/or the computing device 100). The weights and scoring may also be applied globally or may be context-specific. For example, a first set of weights may hold true and be applied near a 5' end of a gene, whereas a different set of weights or a different combination of rules or constraints or conditions or parameters or features may be true and may be applied in a different area of the gene (e.g., in the middle of the gene). As described in the Examples herein, it was empirically found that the following weights for codons choices in *E. coli* may predict a successful swap.

$$\text{score} = (0.65/1.5411) * \text{mRNA}_{ratio} \times (0.35/8.4257) * (1 + \text{LOG}(\text{RBS}_{ratio}))$$

In additional embodiments, the genome design module 201 may follow an automated computational design pipeline as illustrated in FIG. 8. For example, the genome design module 201 may first implement forbidden allele replacement based on the list of alleles 204 and the genome template 202 in all instances of gene overlaps while accounting for biological constraints 205. The genome design module 201 may then apply remaining forbidden allele replacement in each gene independently while accounting for biological constraints 205. For example, for each allele that is to be replaced, there may be multiple choices for synonymous allele substitutions. A design may be minimally disruptive with respect to design rules or constraints or conditions or parameters or features that quantify deviation from the wild-type sequence (e.g. secondary structure, GC content, RBS motif strength).

However, in some embodiments, an exhaustive comparison of all possible allele or codon modifications may be computationally expensive, making iteration slow. For example, in the case of recoding E. coli, there are about 17 forbidden codons per gene and 4 possible synonymous swaps per codon, resulting in $4^{17}$ possible sequences to evaluate per gene. Thus, the genome design module 201 may identify a solution that satisfies each rule or constraint or condition or parameter or feature within a threshold, rather than identifying a global minimum. To identify a satisfactory solution, the genome design module 201 may identify and represent a genome-recoding problem as a graph that is traversed using an algorithm based on depth first search. In some embodiments, the algorithm may be referred to as a graph search-based codon replacement algorithm.

For example, nodes in the graph may represent a unique alternative gene sequence. Sibling nodes in the graph may differ in the value of a specific codon. Children of a node may represent all possible changes to the next downstream codon. Each node may be assigned a score corresponding to each of the rules, including GC content, secondary structure, and codon rarity deviation. Each score may be a quantitative measure of deviation away from wild-type sequence in the respective score profile for a base pair window (e.g., a 40 base pair window or a window of any other number of base pairs) centered at a specific codon. A node may be expanded and pursued as long as all scores are below the thresholds for their respective profiles. If all nodes at a level violate the threshold, the algorithm (e.g., implemented by the genome design module 201) may backtrack to an earlier node and choose a different branch. If the algorithm is unable to find a solution for a particular gene, the threshold constraints may be modified, and a search may be restarted. In some embodiments, the graph search-based algorithm may also be applied in allele replacement for genome design.

After the graph search-based codon (or allele) selection, the genome design module 201 may apply technical rules or constraints or conditions or parameters or features considering synthesis and assembly constraints for genome design. For example, the genome design module 201 may further modify the genome template 202 using the synthesis constraints 206, in order to satisfy DNA vendor constraints, such as by removing specific restriction enzyme sites and homopolymer sequences, and balancing GC content. Finally, the genome design module 201 may partition the modified genome into segments of a predefined size (e.g., segments of any number of bases). For example, the genome design module 201 may first partition the modified genome into ~50 kb segments and then partition each segment into 2-4 kb synthesis units or fragments.

In additional embodiments, the genome design module 201 may also allow users to provide a list of manually-specified modifications for a genome. In some embodiments, these manually-specified modifications (which may be referred to as miscellaneous design notes) may include solutions from empirical validation or special cases for which generalized rules or constraints or conditions or parameters or features have not yet been implemented. For example, in the case of recoding E. coli, the UUG codon, which encodes Leucine using $tRNA^{Leu}$, was chosen as one of the seven codons for replacement throughout protein coding genes. However, when the same codon (UUG) occurs as a translational start codon, it is decoded by $tRNAf^{Met}$, and does not need to be replaced. Thus, a miscellaneous design note was added not to replace these start codons in order to minimize perturbation of gene expression level. The miscellaneous design note may be implemented in the software in order to facilitate automated allele replacement. In another miscellaneous design note, manual substitutions were designated for AGR codons in essential genes based on previous empirical testing. In yet another miscellaneous design note, codons overlapping selenocysteine insertion sequence (SECIS) sites were manually recoded in the following genes: fdhF, fdnG, and fdoG.

The genome design module 201 may ultimately generate a plurality of alternative gene sequences (each comprising a different codon or allele choice) and select at least one alternative gene sequence as the genome design based on weighted scoring. The genome design module 201 may output a final genome design 210 which may comprise a file (e.g., a GenBank file) of the final genome design. In some cases, the genome design module 201 may identify synthesizable DNA by dividing the genome design 210 into contiguous segments, in which each segment is composed of a predetermined number of bases. For example, the genome design module 201 may also generate a list of synthesis-compatible 2-4 kilobase (kb) fragments, which may be synthesized and tested. Furthermore, one or more rules or constraints or conditions or parameters or features for the biological constraints 205 and synthesis 206 may be updated based on empirical testing resulting from the final genome design 210.

In additional embodiments, the final genome design may be based on one of: a genetic code with minor modifications from a canonical genome code, a radically redefined genetic code, a novel genetic code, or a genetic code in which codons map to non-standard amino acids (nsAAs).

Figure 3:
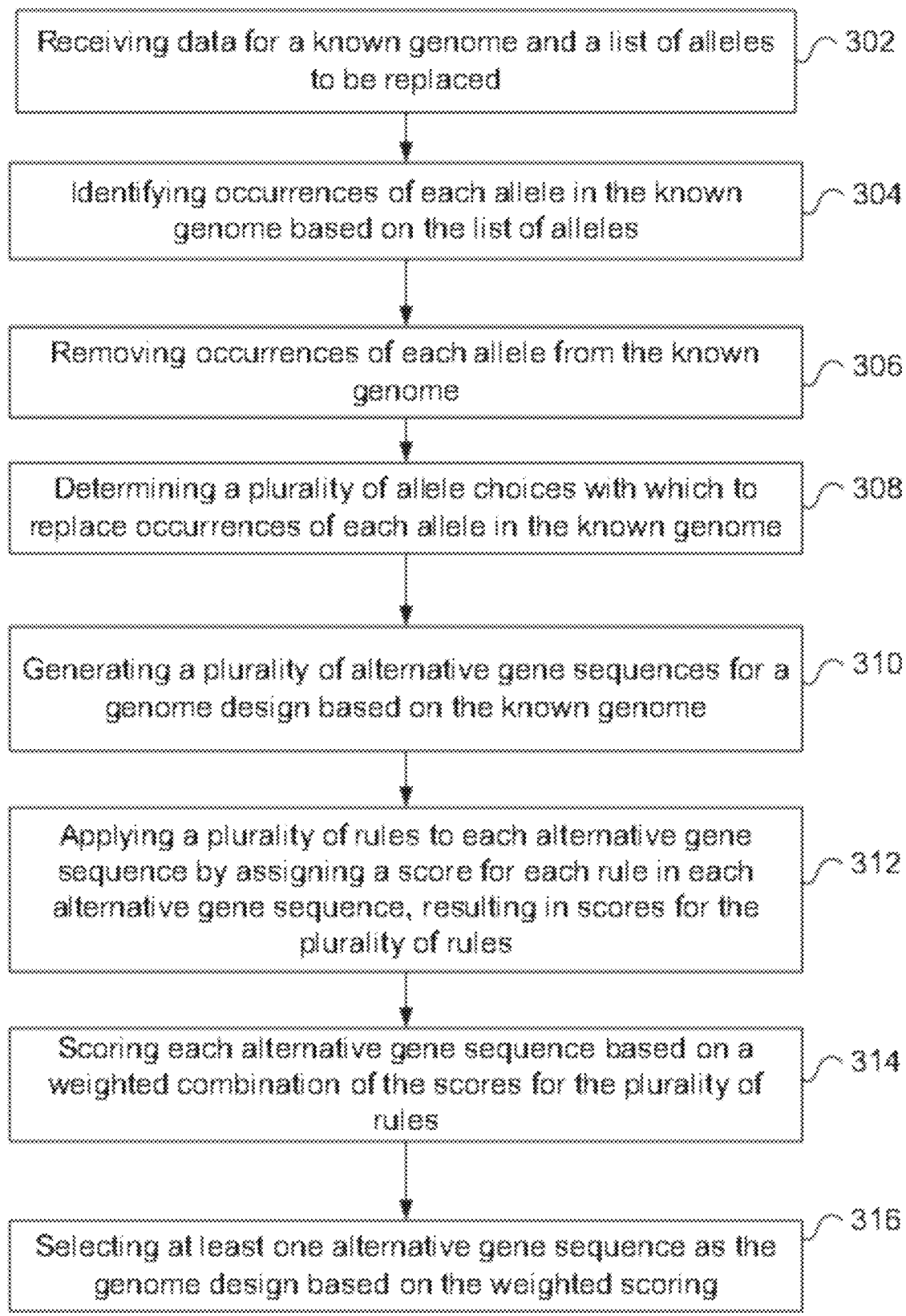
FIG. 3 illustrates an example flow diagram of example method steps for designing genomes in accordance with one or more example embodiments.

FIG. 3 illustrates a flow diagram of an example method in accordance with aspects of the present disclosure. In particular, FIG. 3 illustrates example method steps for designing genomes based on applying rules or constraints or conditions or parameters or features for biological constraints and synthesis constraints and scoring designs. The steps of FIG. 3 may be performed by a computing platform, such as by at least one of a genome design module 101, genome design module 201, scoring sub-module 208, or the like. As a result of the method of FIG. 3, a genome design may be selected and output as a final design.

The method of FIG. 3 may begin with a step 302 of a computing platform receiving data for a known genome and a list of alleles to be replaced in the known genome. For example, the genome design module 201 may receive a genome template 202 (e.g., comprising a known genome reference sequence) and a list of alleles 204 as inputs. At step 304, the computing platform may identify occurrences of each allele in the known genome based on the list of alleles. For example, the genome design module 201 may find all the alleles (e.g., forbidden codons) that are to be replaced in the genome sequence 202. At step 306, the computing platform may remove the occurrences of each allele from the known genome. For example, the genome design module 201 may apply allele replacement or removal in all occurrences in the known genome 202. In some embodiments, the genome design module 201 may apply forbidden codon replacement or removal in the known genome 202.

At step 308, the computing platform may determine a plurality of allele choices with which to replace occurrences of each allele in the known genome. For example, the genome design module 201 may identify that are there are several synonymous allele that may be utilized to replace each occurrence of each allele in the known genome 202. In alternative arrangements, steps 306 and steps 308 of the method may be combined as one step performed by the genome design module 201, in which the genome design module 201 may identify alleles to remove from the known genome and determine a plurality of allele choices with which to replace occurrences of each allele.

At step 310, the computing platform may generate a plurality of alternative gene sequences for a genome design based on the known genome. For example, the genome design module 201 may generate a plurality of alternative gene sequences, in which each alternative gene sequences includes a different allele choice from the plurality of synonymous allele choices.

At step 312, the computing platform may apply a plurality of rules or constraints or conditions or parameters or features to each alternative gene sequence by assigning a score for each rule or constraint or condition or parameter or feature in each alternative gene sequence, resulting in scores for the plurality of rules or constraints or conditions or parameters or features applied to each alternative gene sequence. For example, the genome design module 201 or the scoring sub-module 208 may utilize the one or more rules or constraints or conditions or parameters or features for the biological constraints 205 and synthesis constraints 206 to calculate sores for each rule or constraint or condition or parameter or feature with respect to each allele choice. That is, the scoring sub-module 208 calculate a score for each rule or constraint or condition or parameter or feature, including for preserving coding mRNA secondary structure, preserving ribosome binding site motifs, preserving internal ribosome pausing site motifs, and the like. Each alternative gene sequence (comprising a different allele choice) may have a score calculated for each of the rules or constraints or conditions or parameters or features.

At step 314, the computing platform may score each alternative gene sequence based on a weighted combination of the scores for the plurality of rules or constraints or conditions or parameters or features. For example, the genome design module 201 may implement scoring for each alternative gene sequence as a weighted combination of scores from the specific rules or constraints or conditions or parameters or features. At step 316, the computing platform may select at least one alternative gene sequence as the genome design based on the weighted scoring. For example, the genome design module 201 may select one or more alternative gene sequences as the final genome design 210 based on identifying which alternative gene sequences comprise a weighted score above a predefined threshold. In some cases, after selection, the genome design module 201 may output the final genome design 210 as a Genbank file which may be utilized for synthesis and testing. In some embodiments, after identifying which alternative gene sequences comprise a weighted score above a predefined threshold, the identified alternative gene sequences may be empirically tested individually or as a library (e.g., a mixture of sequences). In additional embodiments, the genome design module 201 may update one or more rules or constraints or conditions or parameters or features in the plurality of rules or constraints or conditions or parameters or features based on comparing rule predictions to empirically observed viability. For example, the final genome design 210 may be synthesized and tested for viability, and results from testing the synthesized final genome design 210 (along with results from other designs) may be used to update and derive new rules or constraints or conditions or parameters or features for future genome design.

In additional embodiments, one or more rules or constraints or conditions or parameters or features in genome design may be updated, such as by utilizing a computing platform (e.g., computing device 100 comprising the genome design module 101 or genome design module 201). First, one or more features of a genome design may be introduced into at least one cell. In some embodiments, one or more features of the genome design may be introduced into the at least one cell by using DNA cleavage to select against a wild-type genotype and/or facilitate homologous recombination. Further examples for introducing features into a cell may include using CRISPR/Cas, transcription activator-like effector nucleases (TALENs), zinc-finger nucleases (ZFNs), meganucleases, restriction endonucleases, or the like.

In other embodiments, one or more features of the genome design may be introduced into the at least one cell by using recombinases/integrases. Additional examples for introducing features into a cell may include using multiplex automated genome engineering (MAGE), lambda red-recombineering, site-specific recombinases/integrases (e.g., Cre, PhiC31, lambda integrase, Flp, etc.), recombinase-mediated cassette exchange (RMCE), or the like. In other embodiments, introducing one or more features of the genome design into the at least one cell may further include synthesizing a partial or whole genome based on the genome design. Additionally, in some embodiments, the one or more features may be tested by a growth assay using a kinetic plate reader. In other embodiments, the one or more features may be tested by an assay to test protein production. In yet additional embodiments, the one or more features may be tested by sequencing representative portions of the cell population at predetermined time points. For example, next-generation sequencing (NGS) may be used to monitor which genotypes become enriched or depleted in the population, which may be interpreted as relative fitness information.

The one or more features that have been introduced into the at least one cell may be tested by an assay in order to identify genome viability and evaluate the phenotype of the one or more features introduced into the at least one cell. In some embodiments, the one or more features may be tested on a vector (e.g., plasmid, cosmid, phagemid, bacteriophage, or artificial chromosome) or integrated into a chromosome. Based on the testing, it may be determined that the one or more features introduced into the at least one cell are expected to be viable or expected to fail according to one or more predefined rules or constraints or conditions or parameters or features for the genome design. The predefined rules or constraints or conditions or parameters or features for genome design may ultimately be updated based on the determination. In some embodiments, the one or more predefined rules or constraints or conditions or parameters or features for genome design may comprise one or more phenotypic and genotypic parameters.

In additional embodiments, the computing platform may update the predefined rules or constraints or conditions or parameters or features for genome design further based on statistical techniques and machine-learning algorithms. For example, the computing platform may update and/or automatically infer new rules or constraints or conditions or parameters or features using representation learning algorithms including, but not limited to, deep learning. Other machine learning techniques may be used for updating and learning new rules or constraints or conditions or parameters or features, including supervised or unsupervised learning, semi-supervised learning, reinforcement learning, and deep learning. These may include specific techniques, such as convolutional neural networks, random forests, hidden Markov models, autoencoders, Boltzmann machines, and the like. In another example, a user may utilize the computing platform to manually define new rules or constraints or conditions or parameters or features based on analysis.

In additional embodiments, genome designs may be generated by a computing platform (e.g., computing device 100 comprising the genome design module 101 or genome design module 201) and may be tested by the computing platform by determining one or more features in the genome design that fail a set of predefined rules or constraints or conditions or parameters or features. In some embodiments, the set of predefined rules or constraints or conditions or parameters or features may comprise one or more phenotypic and genotypic parameters. The computing platform may obtain or access a sample of a known genome sequence (e.g., a known genome sequence that the genome design is based on), the computing platform may further analyze the sample of the known genome sequence. In some embodiments, the computing may determine the one or more features in the genome design that fail a set of predefined rules or constraints or conditions or parameters or features by testing individual mutations in the genome design in parallel. In other embodiments, the computing may determine the one or more features in the genome design that fail a set of predefined rules or constraints or conditions or parameters or features by testing individual mutations in the genome design in multiplex.

The computing platform may predict modifications to the genome design that may be implemented in order to satisfy a predetermined design objective and to increase probability of viability. For example, a predetermined design objective may comprise one or more features of the natural genome that may need to be changed. A natural genome sequence may be viable, whereas a recoded genome sequence or genome design may need to be tested in order to determine if the design is still viable. After predicting the modifications, the computing platform may test the predicted modifications to generate an improved genome design. In some embodiments, the predicted modifications for the genome design may be tested as a mixture. In other embodiments, the predicted modifications for the genome design may be tested using genetic diversity and selection.

The above disclosure generally describes the present invention. All references disclosed herein are expressly incorporated by reference. A more complete understanding can be obtained by reference to the following specific examples which are provided herein for purposes of illustration only, and are not intended to limit the scope of the invention.

EXAMPLES

The following examples are given for the purpose of illustrating various embodiments of the disclosure and are not meant to limit the present disclosure in any fashion. The present examples, along with the methods described herein are presently representative of preferred embodiments, are exemplary, and are not intended as limitations on the scope of the disclosure. Changes therein and other uses which are encompassed within the spirit of the disclosure as defined by the scope of the claims will occur to those skilled in the art. Other equivalent embodiments will be apparent in view of the present disclosure, figures and accompanying claims.

Example I

Design, Synthesis, and Testing of a 57-Codon Genome

According to some aspects, methods are described herein for design and construction of a radically recoded *Escherichia coli*. Recoding, the re-purposing of genetic codons, is a powerful approach to enhance genomes with functions not commonly found in nature. The degeneracy of the canonical genetic code allows the same amino acid to be encoded by multiple synonymous codons. The near universality of a 64-codon code among natural organisms (Crick, 1963) makes codon replacement a powerful tool for genetic isolation of synthetic organisms. For example, while most organisms follow a common 64-codon template for translation of cellular proteins, deviations from this universal code found in several prokaryotic and eukaryotic genomes (Ambrogelly et al. 2007, Kano et al., 1991, Oba et al., 1991, Macino et al., 1979, Ling et al., 2015) have spurred the exploration of synthetic organisms with expanded genetic codes.

Whole-genome synonymous codon replacement provides a mechanism to construct unique organisms exhibiting genetic isolation and expanded biological functions. Once a codon is synonymously replaced genome-wide and its cognate tRNA is eliminated, the genomically recoded organism (GRO) may no longer translate the missing codon (Lajoie et al., 2013b). Therefore, genetic isolation is achieved since DNA acquired from natural viruses, plasmids and other organisms would be improperly translated, rendering the recoded strain insensitive to infection by viruses and horizontal gene transfer (FIG. 4).

Figure 4:
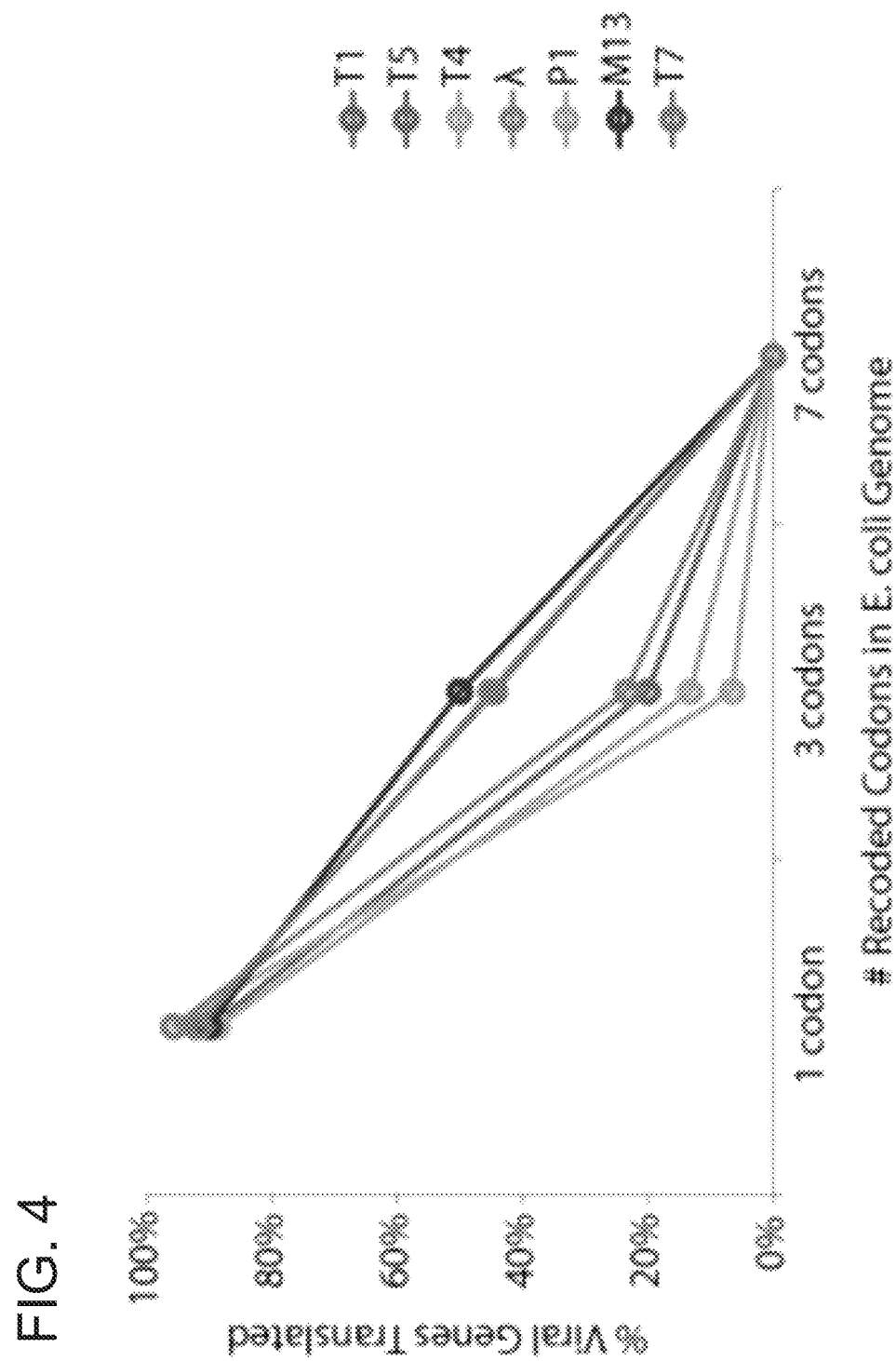
FIG. 4 illustrates an example graph of predicted viral resistance of recoded genomes.

For example, FIG. 4 illustrates, for a panel of coliphages, the percent of bacteriophage genes that are predicted to be properly translated in recoded *E. coli* strain with an increasing number of unassigned missing codons (e.g., no cognate translation). In this example, 1 codon=UAG; 3 codon=UAG, AGG, and AGA; and 7 codons=UAG, AGG, AGA, AGC, AGU, UUG, and UUA.

The gene translation percentage may be computed by the following equation.

$$\text{Gene translation \%} = \frac{\text{Total \# of genes in given viral genome} - \text{\# of viral genes containing forbidden codons}}{\text{Total \# of genes in given viral genome}}$$

Furthermore, proteins with novel chemical properties may be explored by reassigning replaced codons to incorporate non-standard amino acids (nsAAs) functioning as chemical handles for bioorthogonal reactivity, photoresponsive elements, or biophysical probes (Liu et al., 2010). Codon reassignment has also made it possible to establish metabolic dependence on nsAAs that do not naturally exist in the environment, enhancing biocontainment of GROs which may be a major consideration in environmental, industrial and medical applications (Marliere, 2009, Mandell et al., 2015, Rovner et al., 2015). In some embodiments, non-standard amino acids (nsAAs) may comprise any amino acid other than the 20 canonical protein coding amino acids. In other words, nsAAs may include any amino acid incorporated using one or more codons whose assignment differs from those of a given natural organism.

Figure 5A:
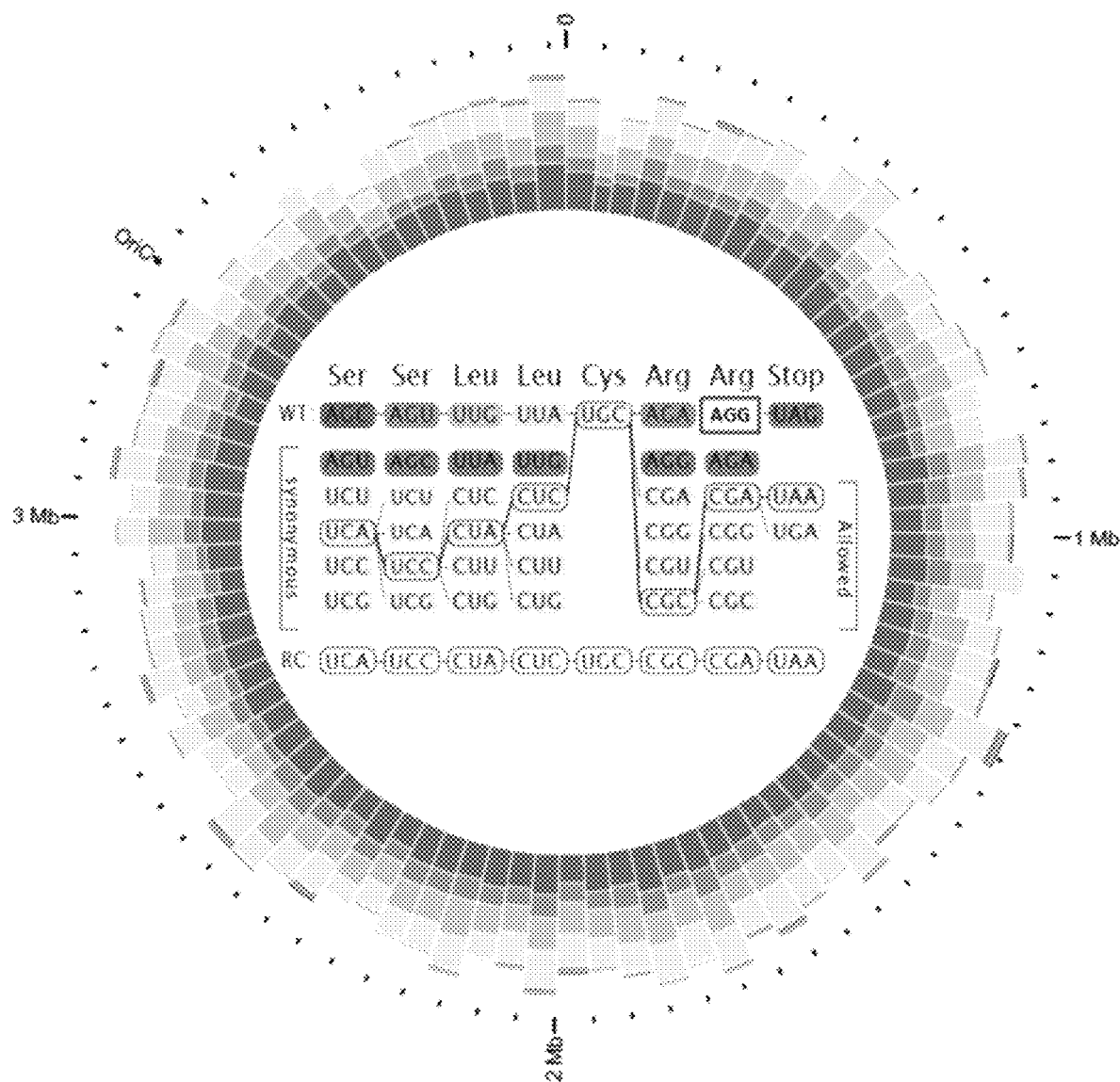
FIGS. 5A-5C illustrate an example of a 57-codon *E. coli* genome.
Figure 5B:
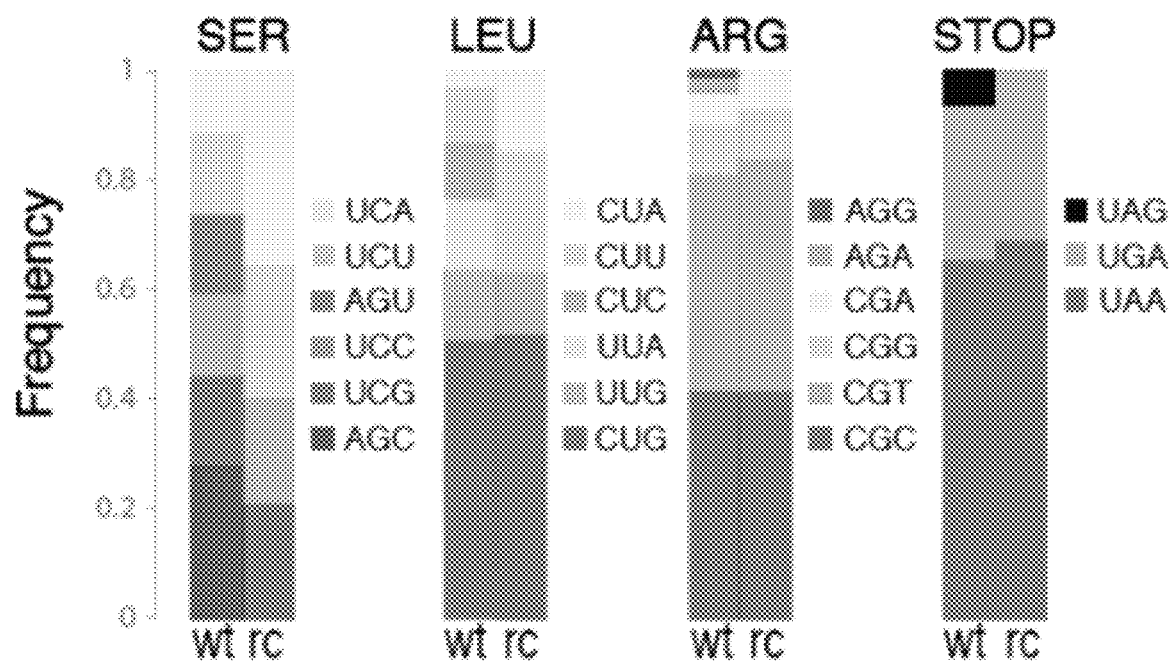
Figure 5C:
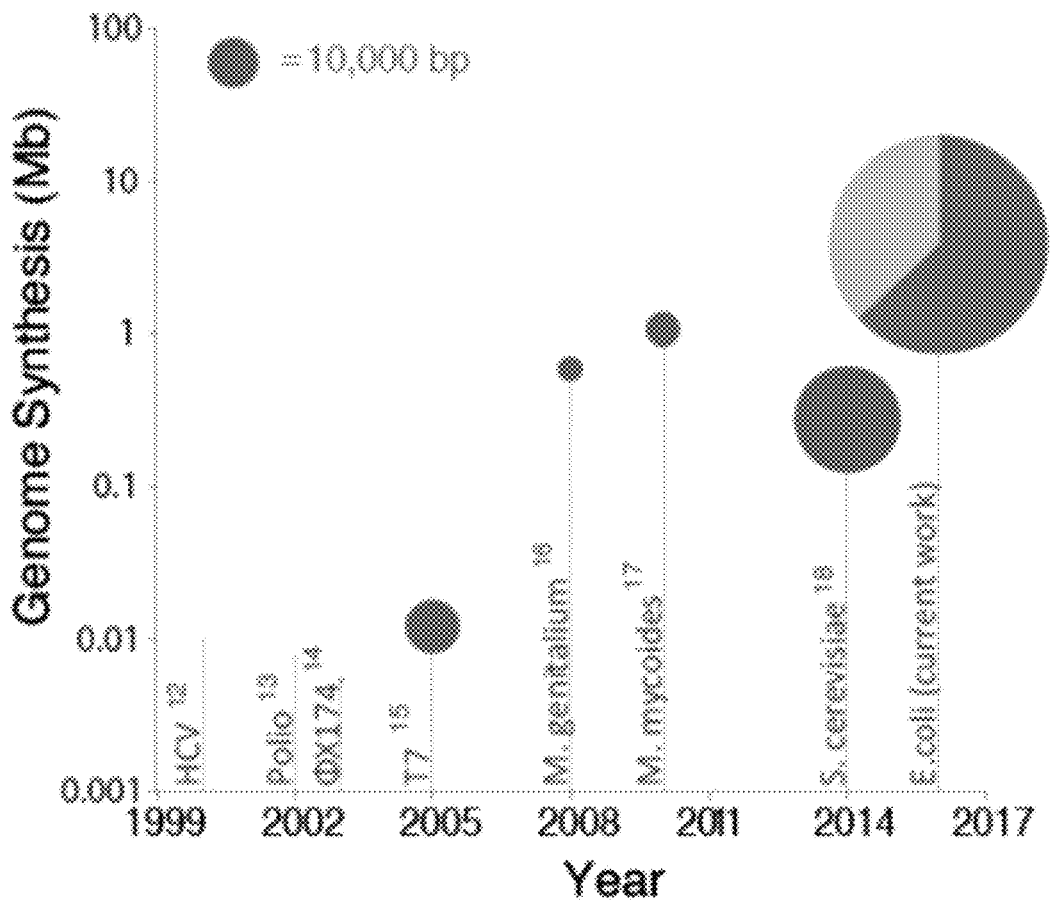
Figure 7:
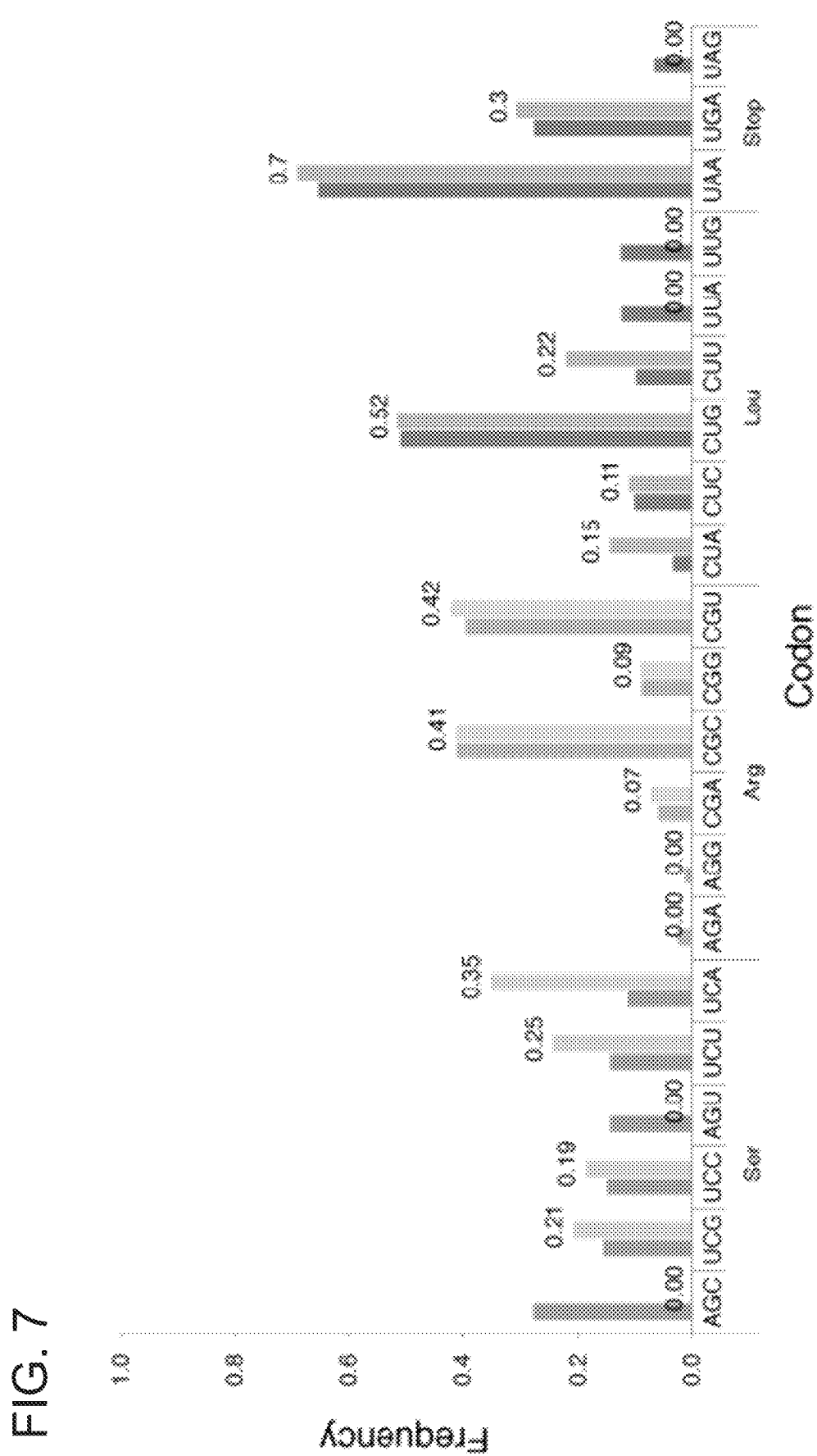
FIG. 7 illustrates Serine, Arginine, Leucine and Stop codon frequency is for E. coli MDS42 (dark color) and the computationally designed rE. coli-57 genome (light color, frequency labeled).
Figure 9A:
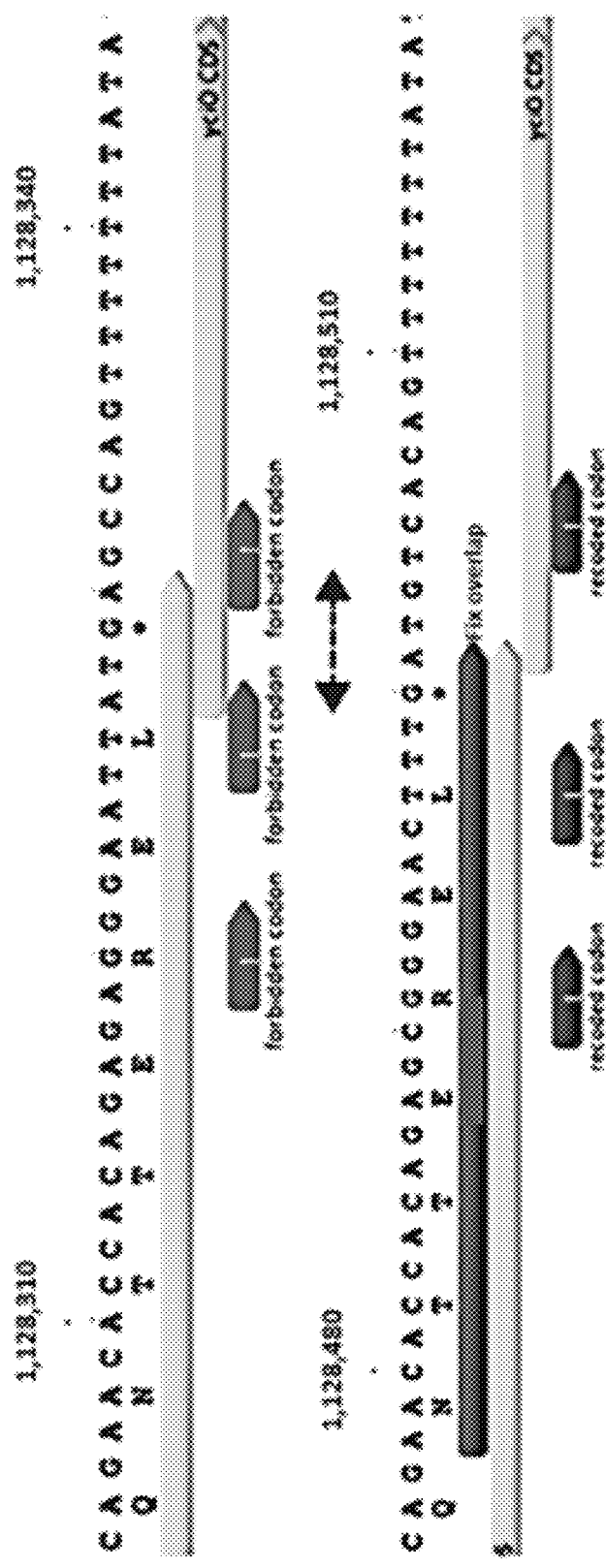
Figure 9A:
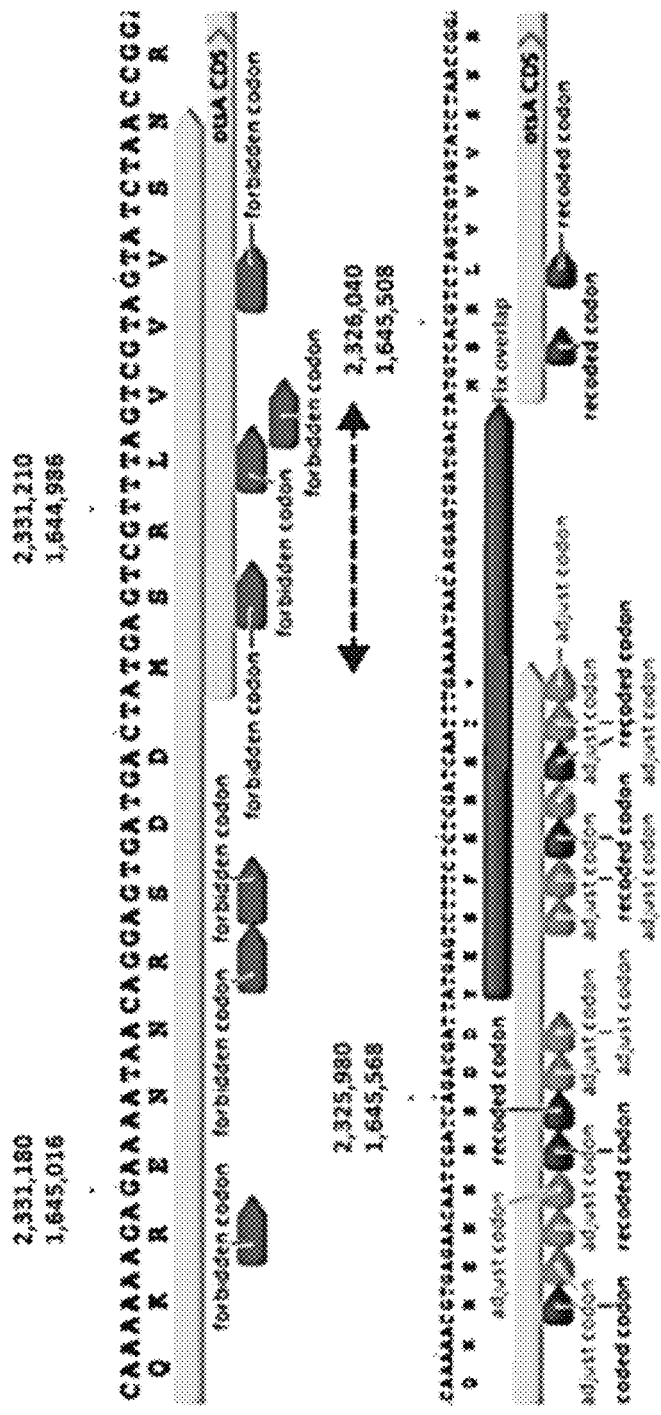
Figure 9B:
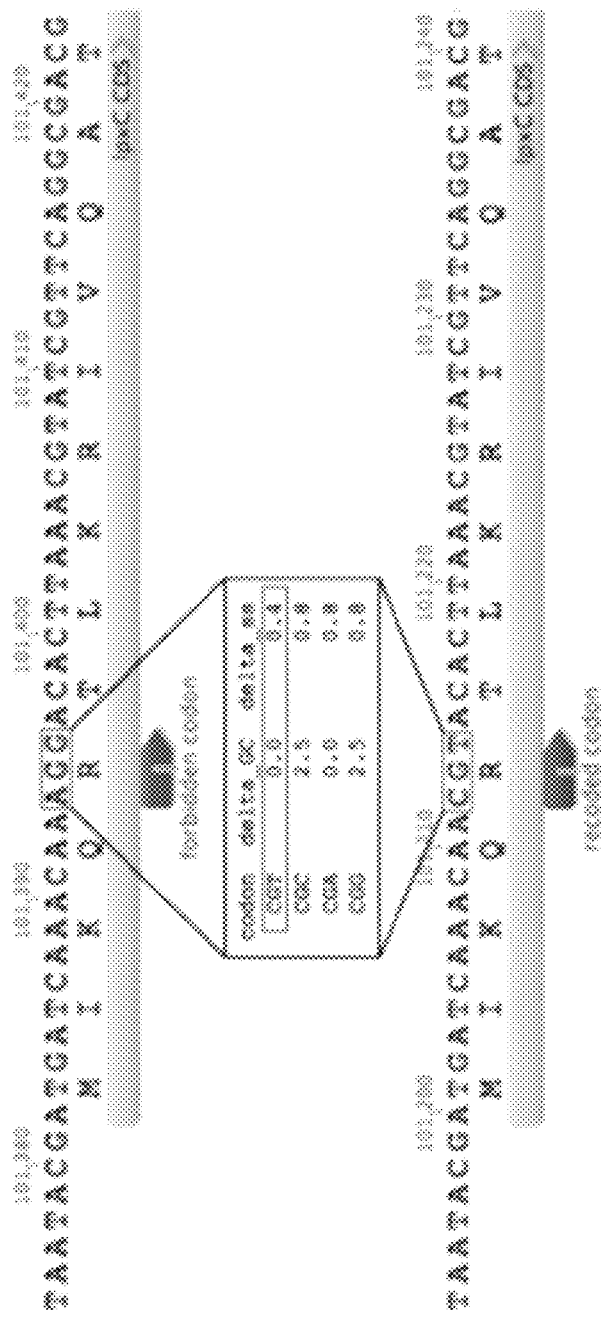
Figure 9C:
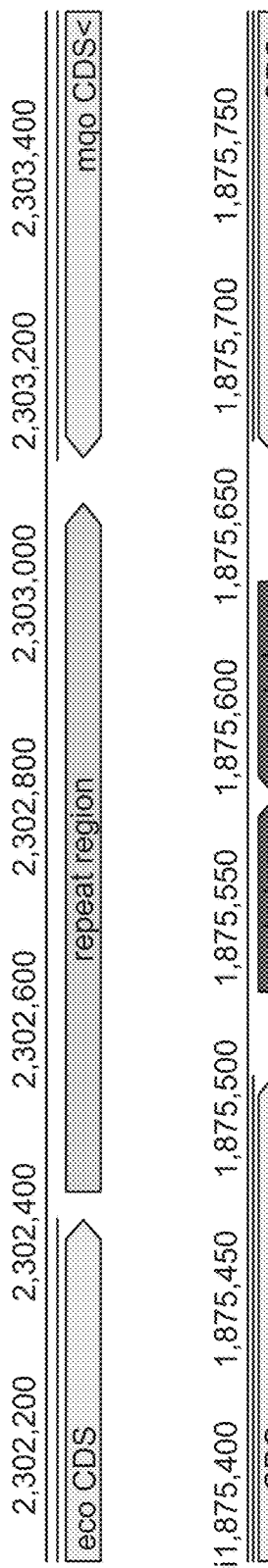
Figure 9D:
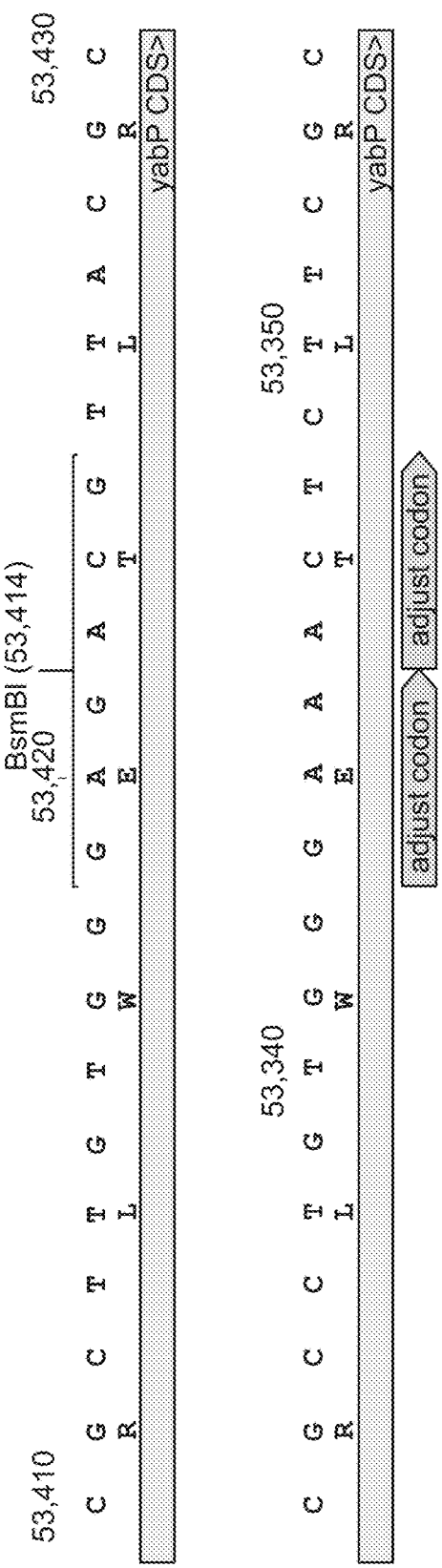
Figure 9E:
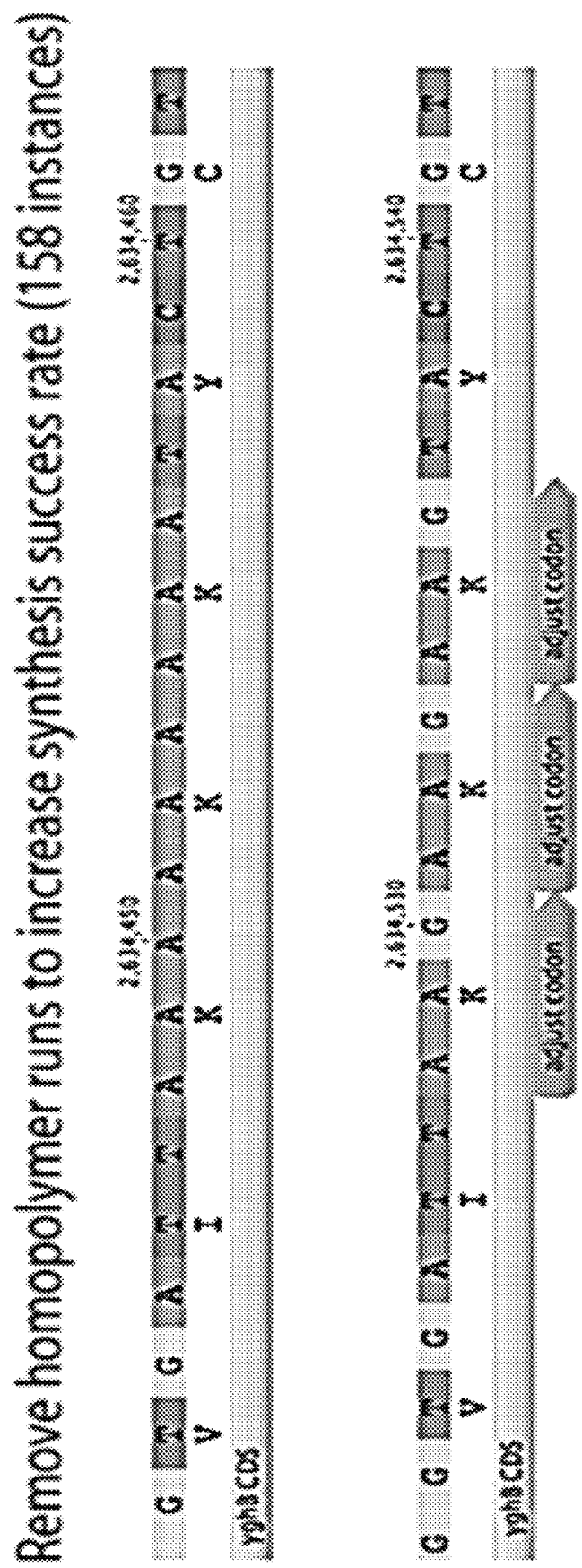

Described herein are methods for multiple codon replacements genome-wide, with the aim of producing a virus-resistant, biocontained organism relevant for industrial applications. A computational design is presented, along with experimental testing of 2.5 Mb (63%) of an *E. coli* genome in which all 62,214 instances of seven different codons (corresponding to 5.4% of all *E. coli* codons) have been synonymously replaced (FIG. 5A-5C). The new recoded genome may be referred to as r*E. coli*-57 as described herein and is composed of 57 of canonical 64 codons when assembled (FIG. 6). While several synthetic genomes have been previously reported (Blight et al., 2000, Cello et al., 2002, Smith et al., 2003, Chan et al., 2005, Gibson et al., 2008, Gibson et al., 2010, Annaluru et al., 2014), a functionally altered synthetic genome of this scale has not yet been explored (FIG. 5C).

In some cases, alterations of codon usage may affect gene expression and cellular fitness at multiple levels from translation initiation to protein folding (Kudla et al., 2009, Tuller et al., 2010, Plotkin et al., 2011, Goodman et al., 2013, Zhou et al., 2013, Quax et al., 2015, Boël et al., 2016). Yet, parsing the individual impact of codon choices may remain difficult, imposing a barrier to designing new genomes. The present disclosure provides prediction tools and efficient technologies to rapidly prototype synthetic genomes.

In order to address the unprecedented scale and complexity of genome engineering goals, computational tools, cost-effective de novo synthesis strategy, and a comprehensive experimental validation plan as described herein. For example, the number of modifications required to replace all instances of seven codons may be far beyond the current capabilities of single-codon editing strategies previously used for genome-wide replacement of the UAG codon (Lajoie et al., 2013b, Isaacs et al., 2011). Although it may be possible to simultaneously edit multiple alleles using MAGE (Wang et al., 2009) or Cas9 (Esvelt et al., 2013), these strategies may involve extensive screening using numerous oligos and RNA guides and may likely introduce off-target mutations (Wang et al., 2009). De novo synthesis allows for an almost unlimited number of modifications independent of biological template. Moreover, the plummeting costs of DNA synthesis are reducing financial barriers for synthesizing entire genomes.

For this example, the following three codons were chosen for replacement: the UAG stop codon and the AGA and AGG arginine codons (FIG. 6). These codons were also among the rarest codons in the genome, minimizing the number of changes required. The other codons were chosen such that their anticodon is not recognized as a tRNA identity element by endogenous aminoacyl-tRNA synthetases, so that heterologous tRNAs will not be mischarged with canonical amino acids upon incorporation of nsAAs. Lastly, to allow unambiguous reassignment, codons were chosen whose tRNA do not overlap with other synonymous codons for the same amino acid. Thus, the following seven codons (termed 'forbidden codons') were targeted for replacement: AGA (Arg), AGG (Arg), AGC (Ser), AGU (Ser), UUG (Leu), UUA (Leu) and UAG (Stop) (FIG. 5A-5C, FIG. 6, FIG. 3).

In order to minimize synthesis costs and improve genome stability, the 57-codon genome described herein is based on the reduced-genome *E. coli* strain MDS42 (Pósfai et al., 2006). The disclosed computational tool automates synonymous replacements for all occurrences of the target codons in all protein-coding genes while satisfying biological and technical constraints, in which examples of these constraints are illustrated in FIGS. 8-9 and Tables 1-2. In particular, amino acid sequences of all coding genes were preserved, and protein synthesis levels were maintained by separating overlapping genes carrying forbidden codons and by introducing synonymous codons to minimize potential recombination events (Chan et al., 2005, Temme et al., 2010). The relative codon usage of the remaining codons was conserved to meet translational demand (Yona et al., 2013) and to preserve characteristics of the primary nucleotide sequence, including predicted ribosome binding site (RBS) strength, mRNA secondary structure folding energy, and GC content (Lajoie et al., 2013b, Lajoie et al., 2013a). Finally, adjustments were made to avoid difficult-to-synthesize sequences from the final genome design (e.g., removing homopolymers, normalizing regions of extreme GC content and reducing repetitive sequences) (FIGS. 9A-9G).

Overall, forbidden codons were uniformly distributed throughout the genome, averaging about 17 codon changes per gene. Essential genes (Yamazaki et al., 2008), which provide a stringent test for successful codon replacement, contain about 6.3% of all forbidden codons (3,903 of 62,214 codons). Altogether, the recoded genome necessitated a total of 148,955 changes to remove all instances of forbidden codons and adjust the primary DNA sequence to accommodate design constraints.

Once designed, the recoded genome was parsed into 1,256 synthesis-compatible overlapping fragments of 2 to 4 kilobases (kb). 87 segments of about 50-kb were individually assembled and tested (FIG. 8). Segments of about 50-kb contain a manageable number of genes, averaging about 40 total genes and about 3 essential genes per segment. Additionally, it was found that 50-kb may be a convenient size for assembly in yeast and shuttling into *E. coli*. Importantly, based on earlier studies (Mandell, D. J. et al., Biocontainment of genetically modified organisms by synthetic protein design. *Nature*. 518, 55-60 (2015); K. M. Esvelt et al., Orthogonal Cas9 proteins for RNA-guided gene regulation and editing. *Nat. Methods*. 10, 1116-1121 (2013)) it was estimated that each segment would on average contain only about 1 potentially lethal recoding exception.

Figure 10A:
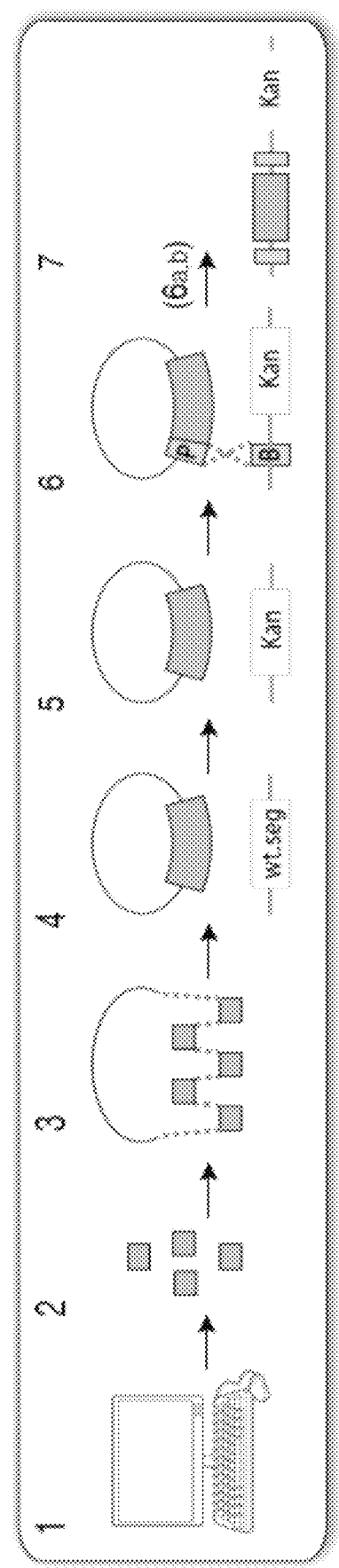
FIGS. 10A-10C illustrate an experimental strategy for recoded genome validation.
Figure 10B:
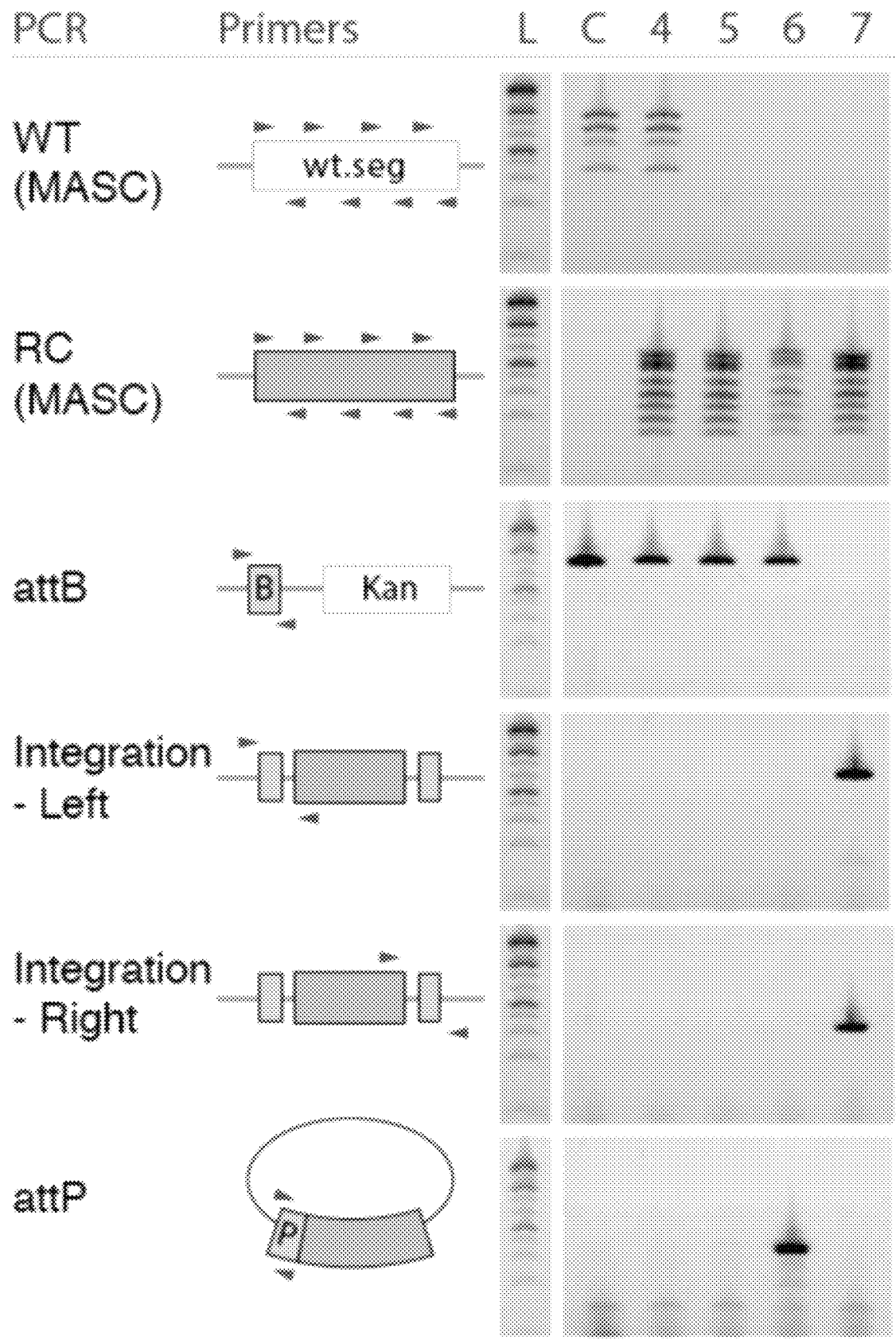
Figure 10C:
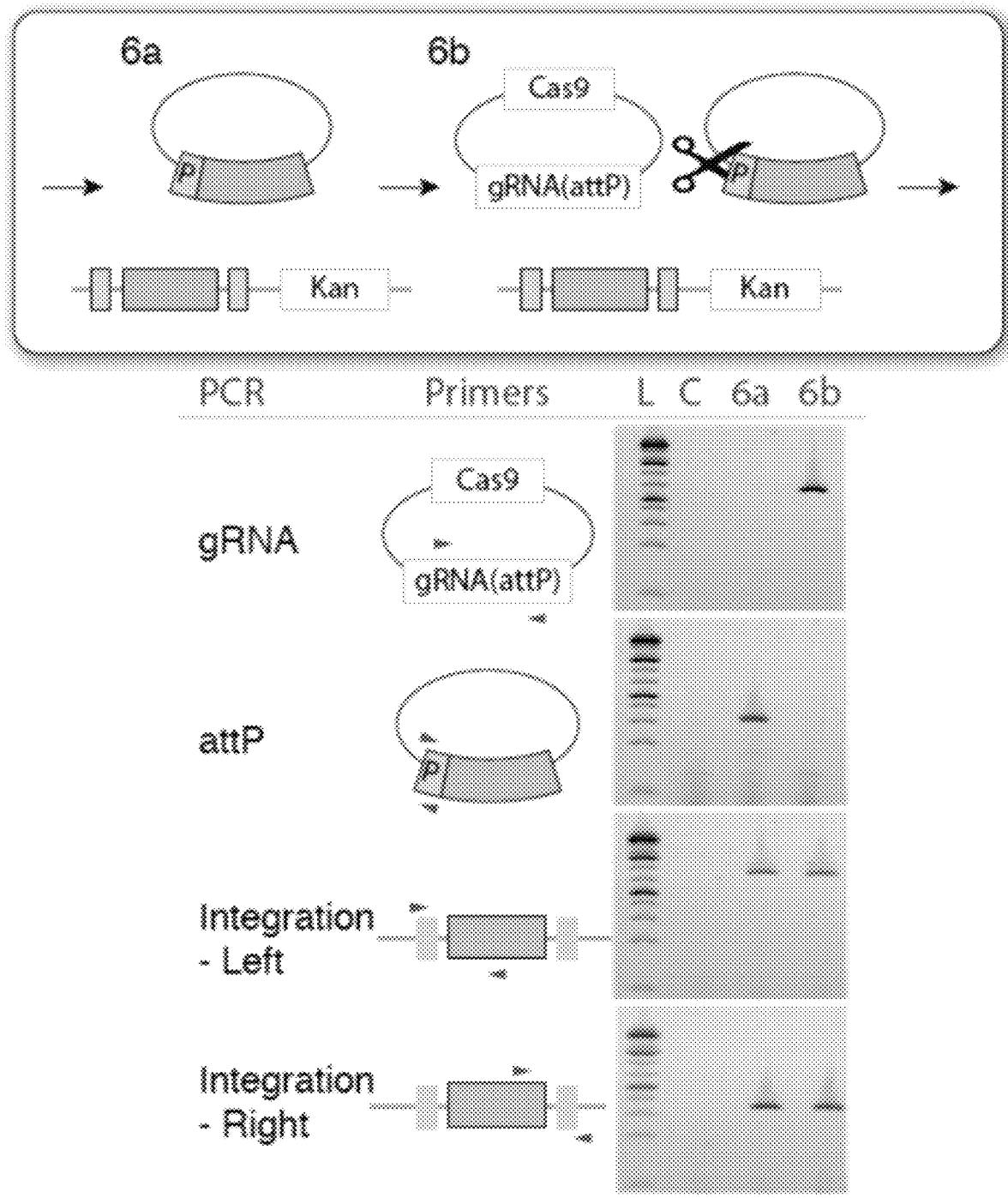
Figure 11:
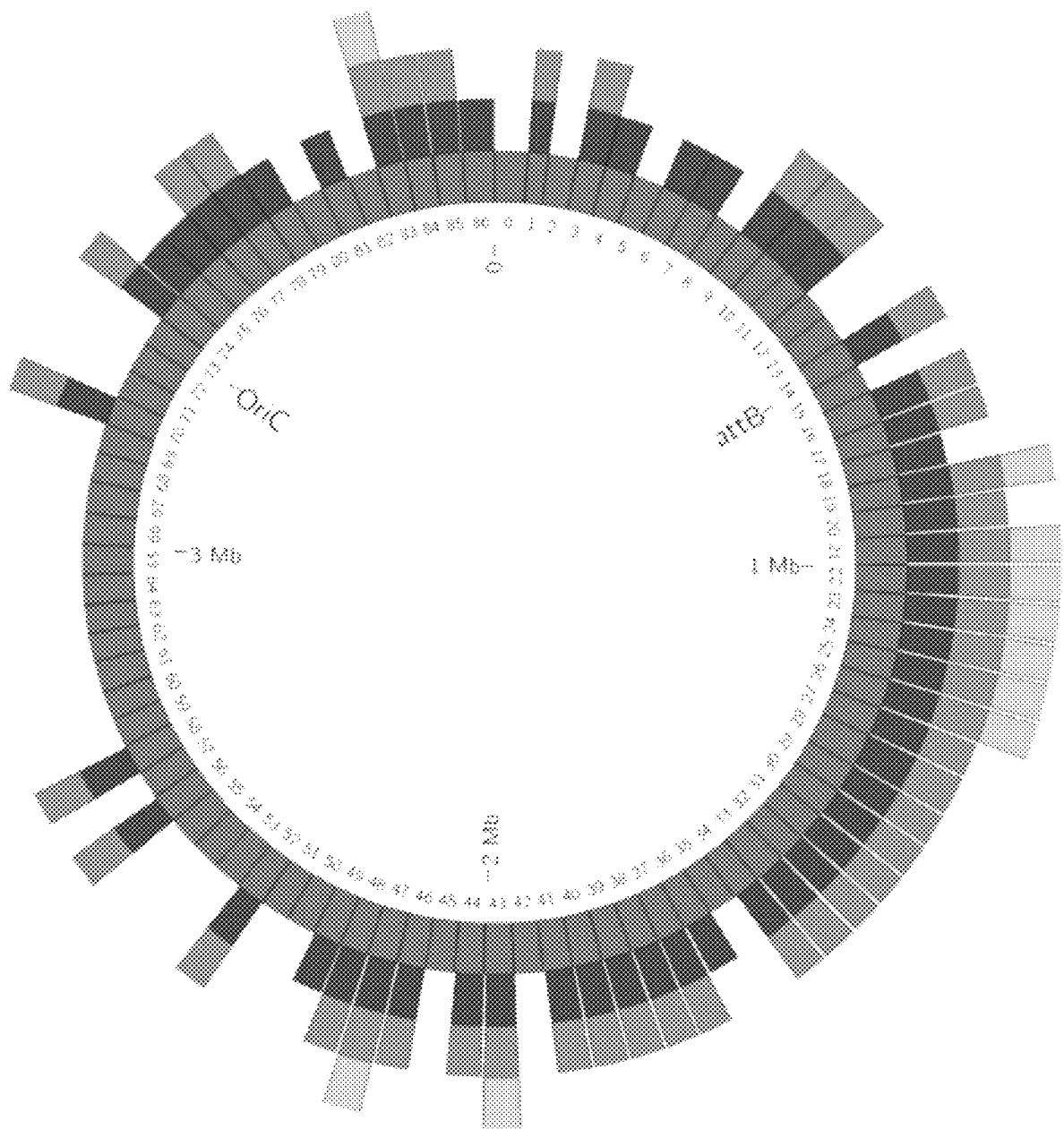
FIG. 11 illustrates an example of rE. coli-57 genome construction. The genome was parsed into 87 segments, each ~50 kb in size. All recoded segments were de novo synthesized (green). A total of 55 segments were tested in vivo thus far (blue), of which 44 were successfully validated for all gene functionality on low copy plasmids (red), and 10 segments were further successfully reduced to single copy of all recoded genes (yellow)
Figure 12A:
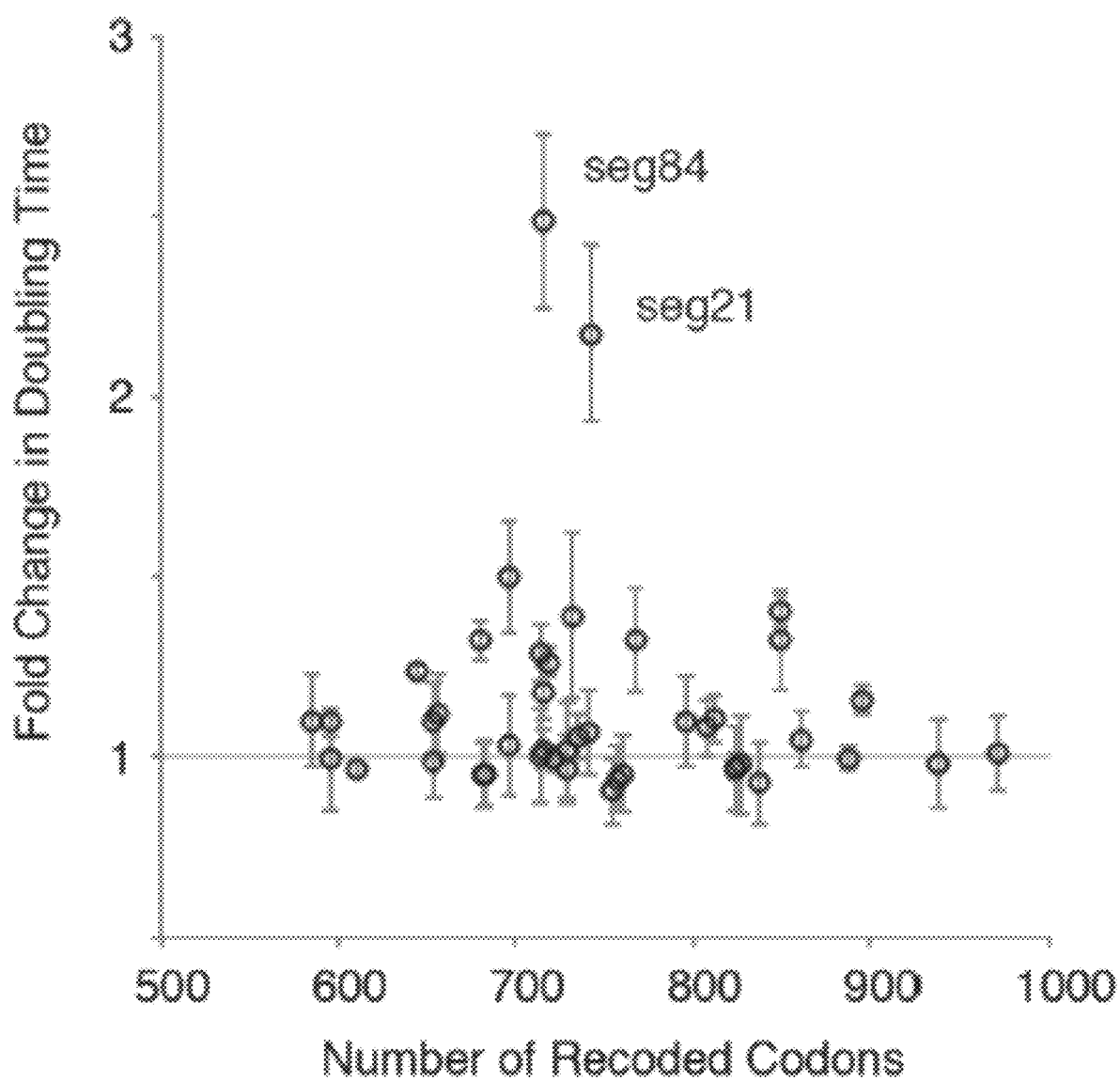
FIGS. 12A-12D illustrate phenotypic analysis of recoded strains.
Figure 12B:
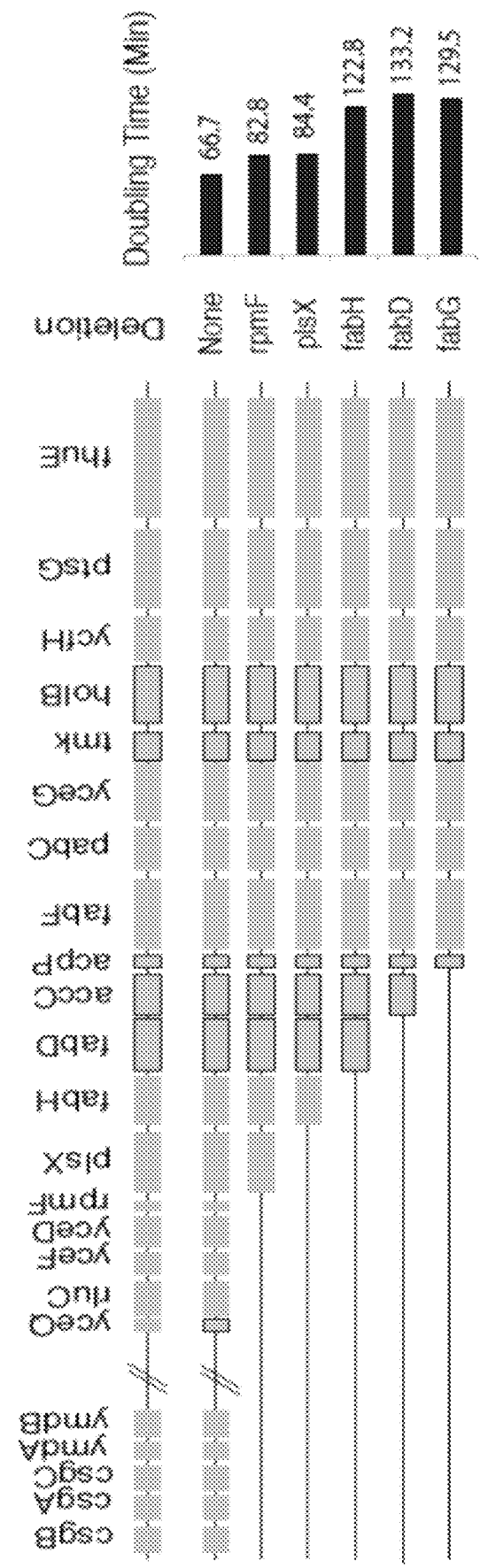
Figure 12C:
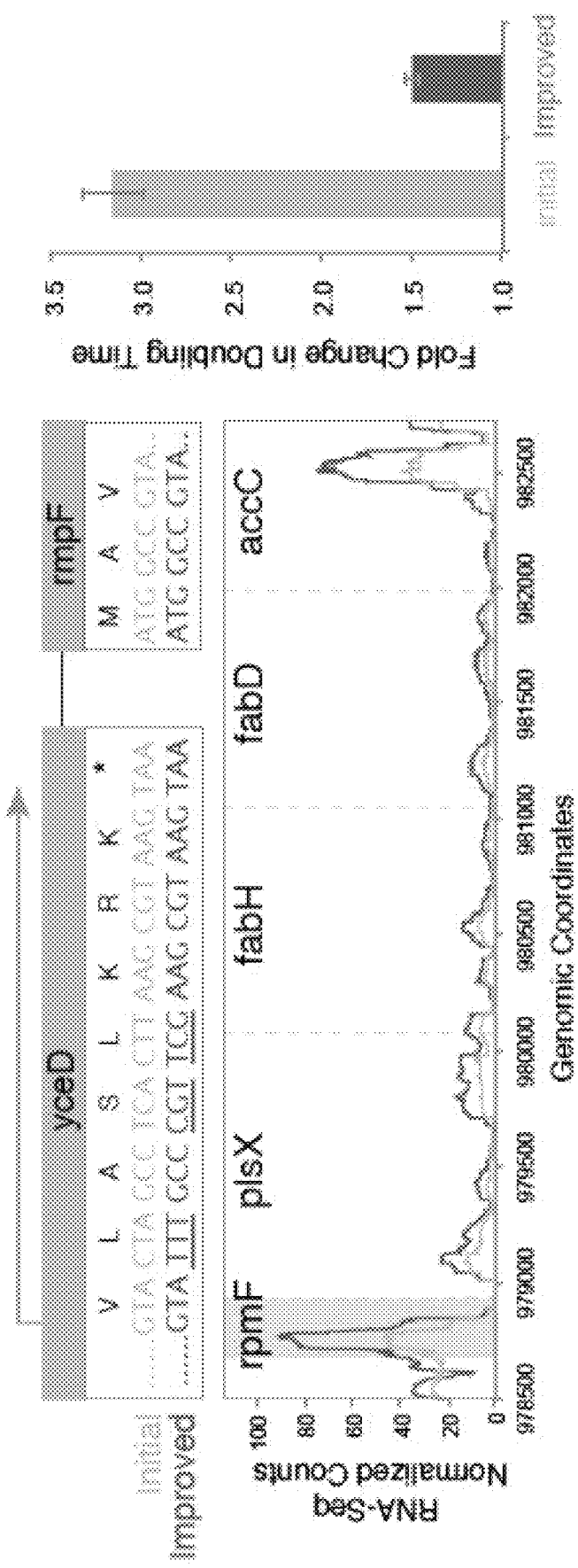
Figure 12D:
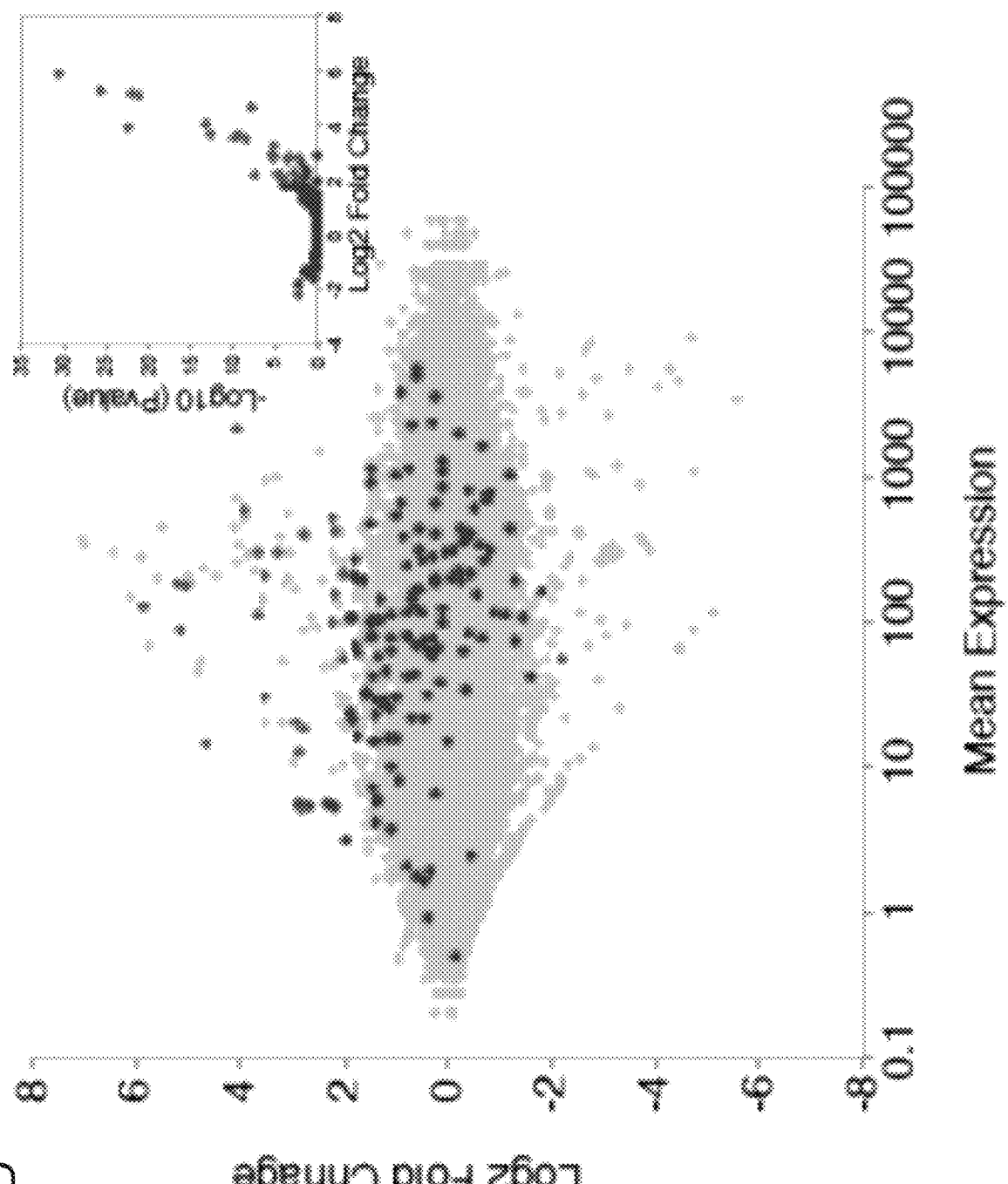
Figure 13A:
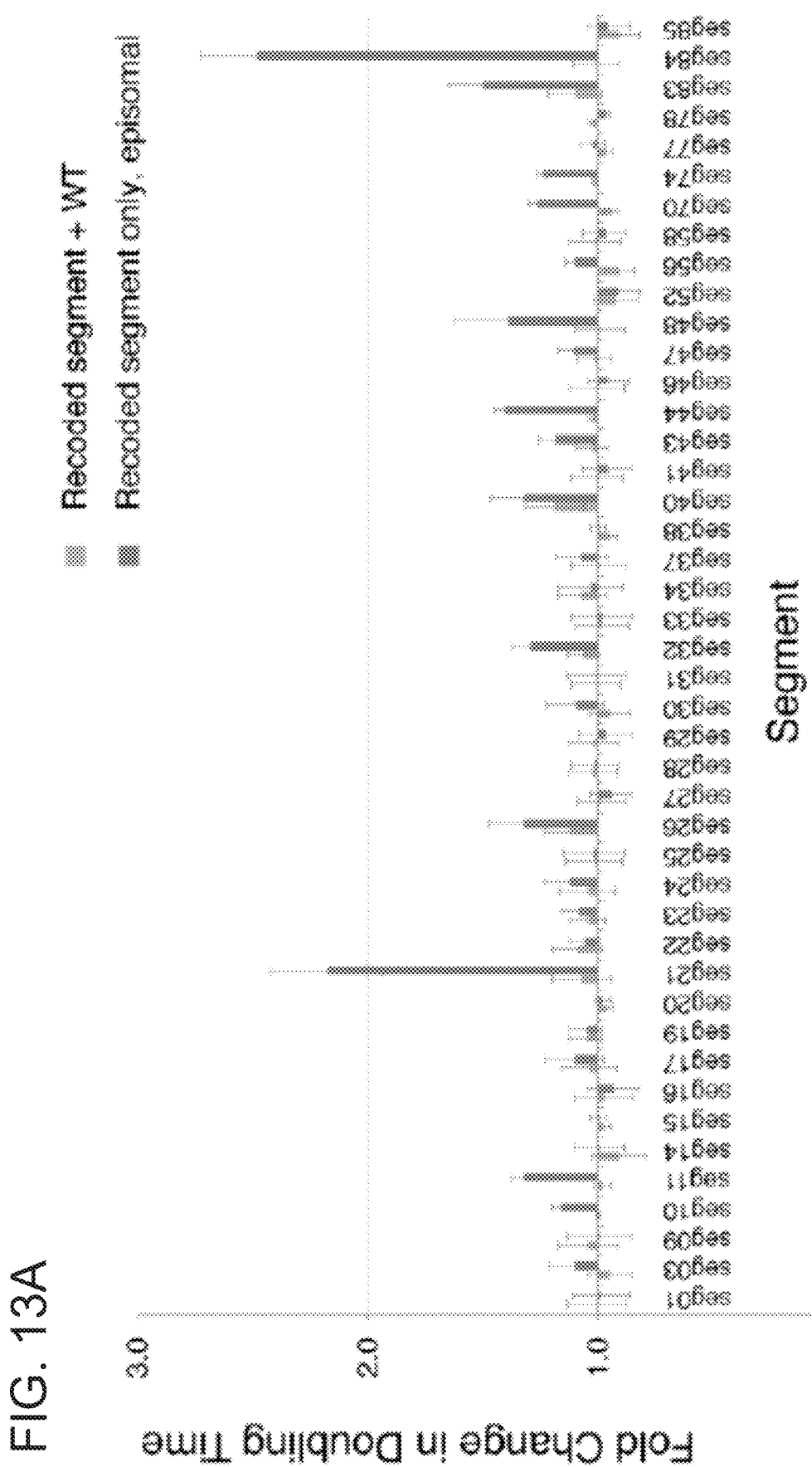
FIGS. 13A-13B illustrate graphs representing fitness of partially recoded strains.
Figure 13B:
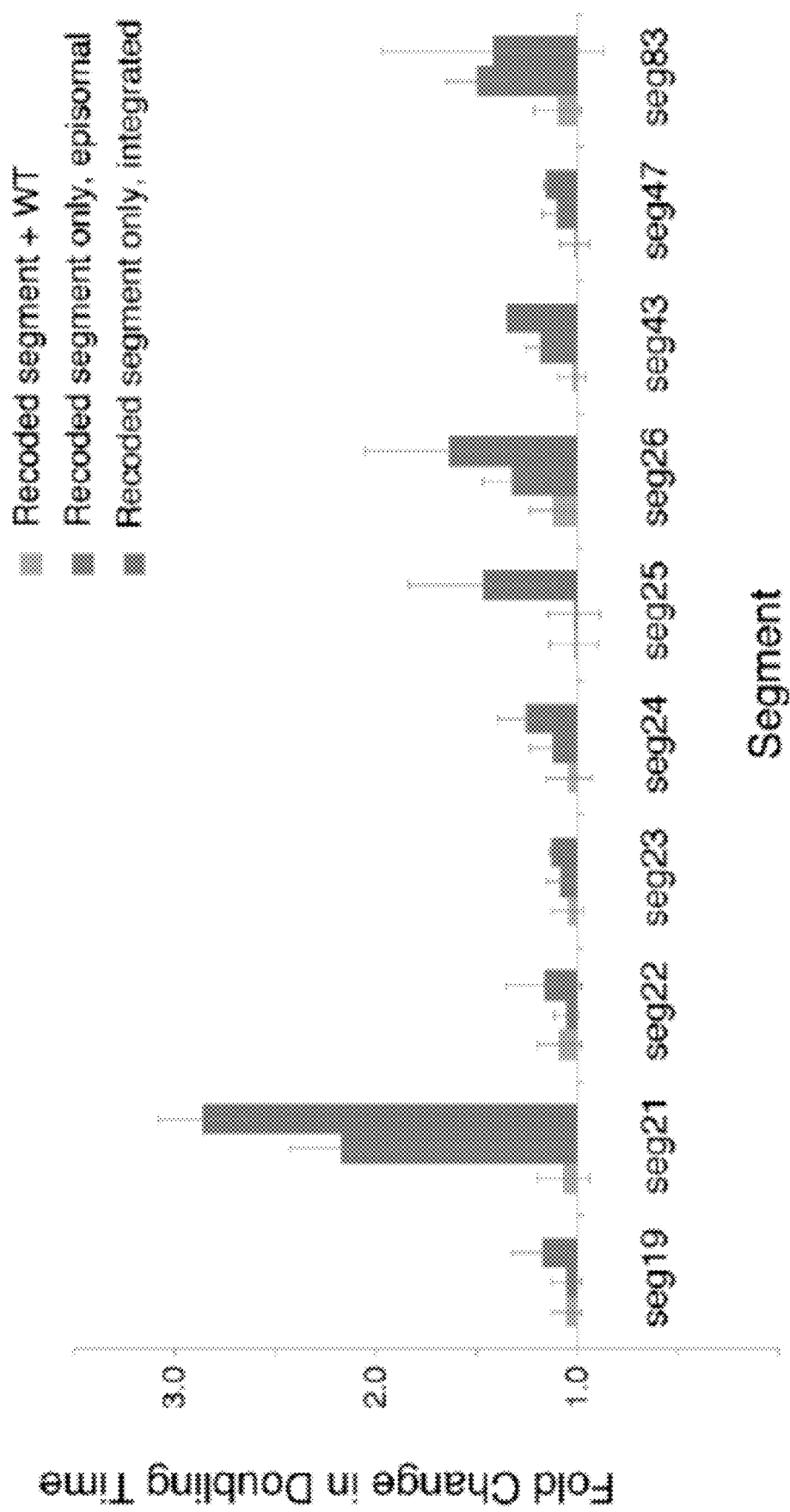

FIGS. 10A-10C outline the experimental strategy utilized in this example. In brief, each segment was assembled in *S. cerevisiae* and electroporated directly into *E. coli* on a low copy plasmid. Subsequent deletion of the corresponding chromosomal segment provides a stringent test for the function of the recoded genes because errors in essential genes would be lethal. Thus far, chromosomal deletions for 2,229 recoded genes across 55 segments have been performed, accounting for 63% of the entire genome and 53% of essential genes (FIG. 11). Additionally, all recoded genes in 44 of these 55 segments were found to complement wild-type chromosomal genes without requiring any optimization. The growth of these strains was assessed, and gene expression was analyzed via RNA-Seq (FIGS. 12A-12B). Moreover, the majority of these strains exhibited only marginal fitness impairment upon chromosomal deletion (FIG. 12A, FIGS. 13A-13B).

Figure 14A:
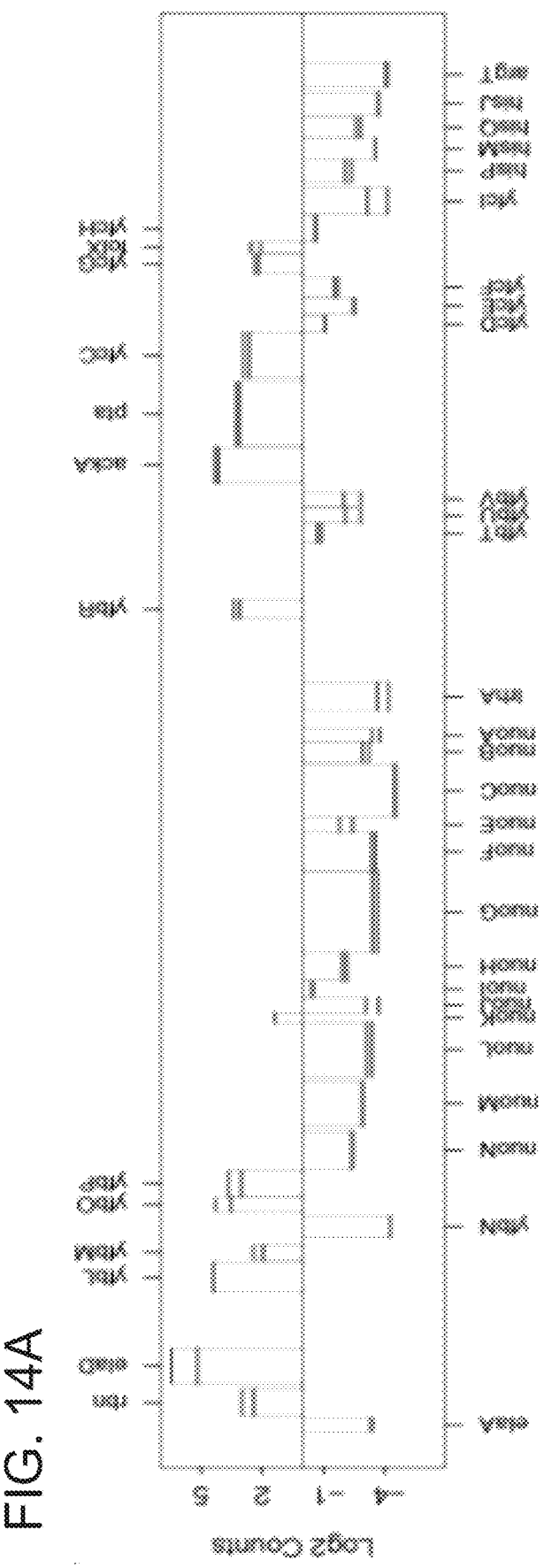
FIGS. 14A-14B illustrate a transcriptional landscape of recoded segment 43, in which expression levels of all genes within segment 43 are shown. Genes were analyzed in non-recoded strain (TOP10) and after chromosomal deletion. RNA was prepared independently for the different strains, and sequenced on an Illumina MiSeq using PE150 V2 kits (Illumina). For analysis of differential expression, counts were aggregated corresponding to genes using Genomic Features (Bioconductor). Counts obtained per gene were normalized at the genome-wide level using DESeq2 package (Bioconductor) (Anders et al., 2010).
Figure 14B:
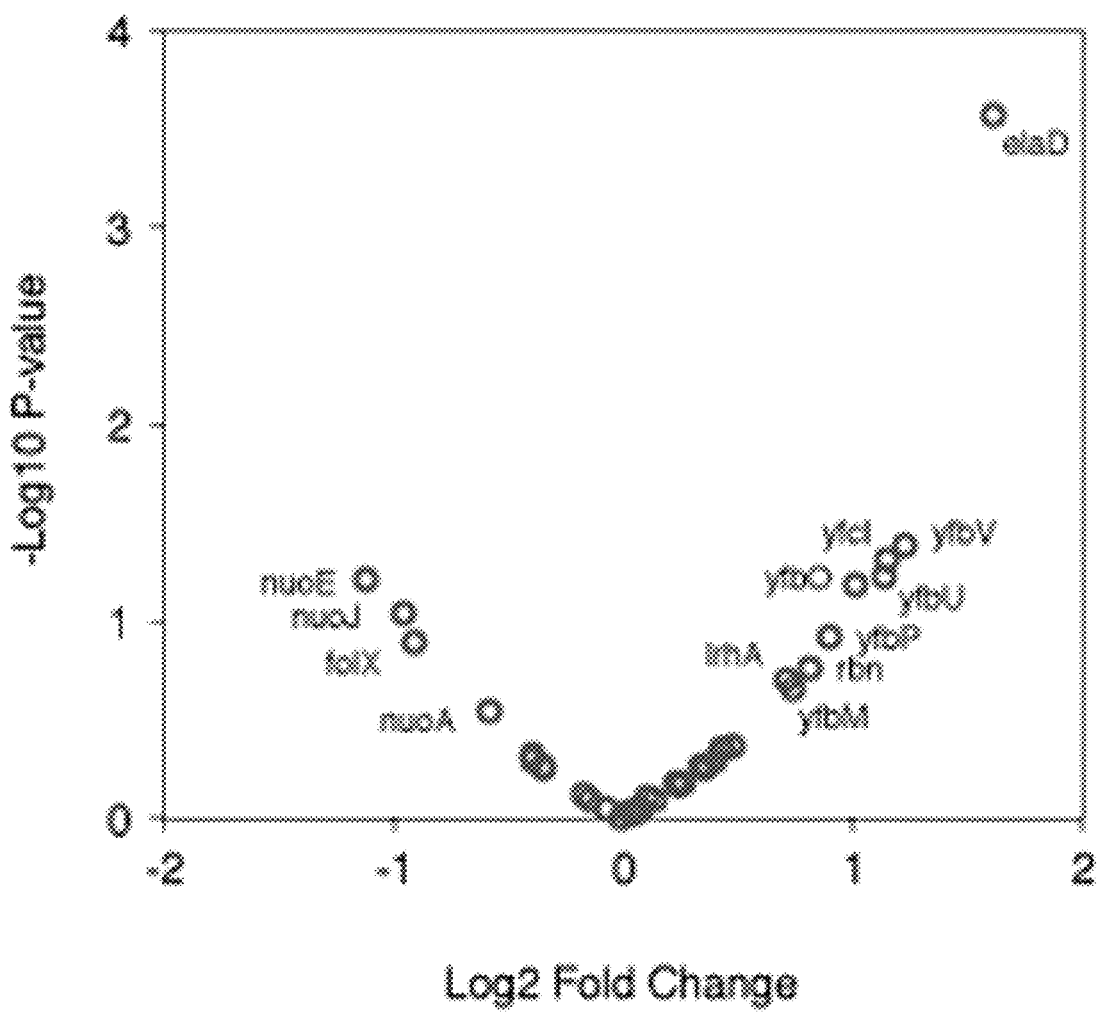

Furthermore, RNA-Seq analysis of 208 recoded genes suggests the majority show only minor change in transcription due to codon replacement (FIG. 14A-14B). Only 28 genes were found to be significantly differentially expressed (i.e., >2-fold change, p<0.01) (27 overexpressed, 1 underexpressed).

Recoded segments that failed to complement the entire wild-type segment (e.g., 11 of 55 segments) were tested by making small chromosomal deletions of the region until the causal gene(s) was localized. Overall, 13 recoded essential genes were found that failed to support cell viability due to synonymous codon replacement. In some embodiments, these may be referred to as "design exceptions."

Figure 15A:
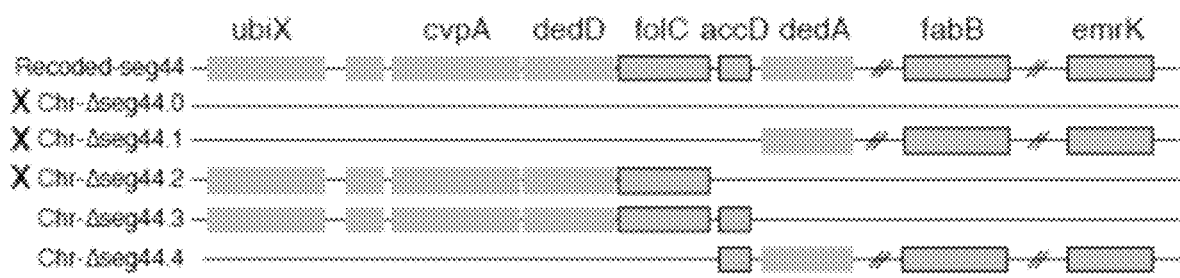
FIGS. 15A-15B illustrate an example of troubleshooting lethal design exceptions.
Figure 15B:
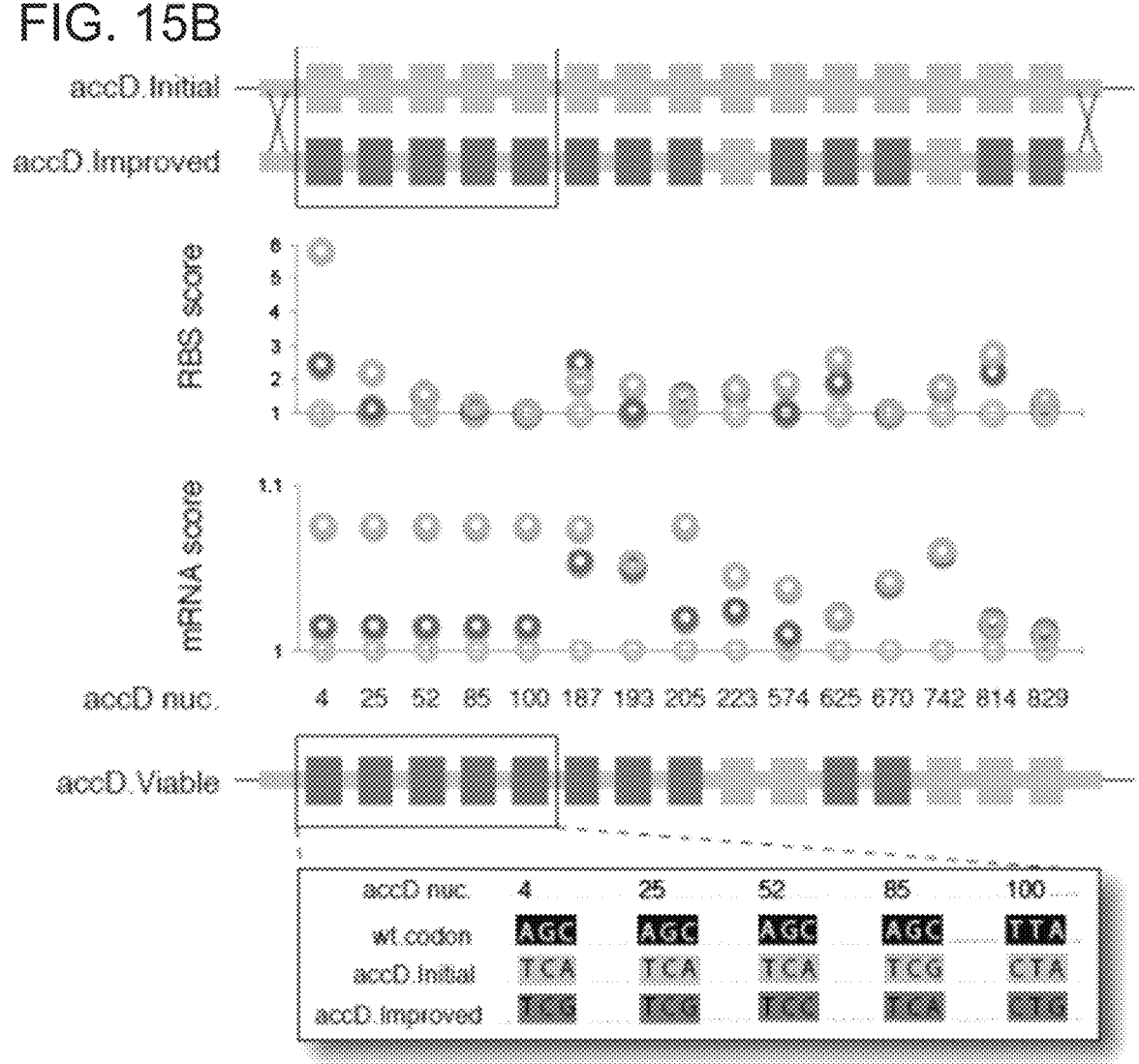
Figure 16:
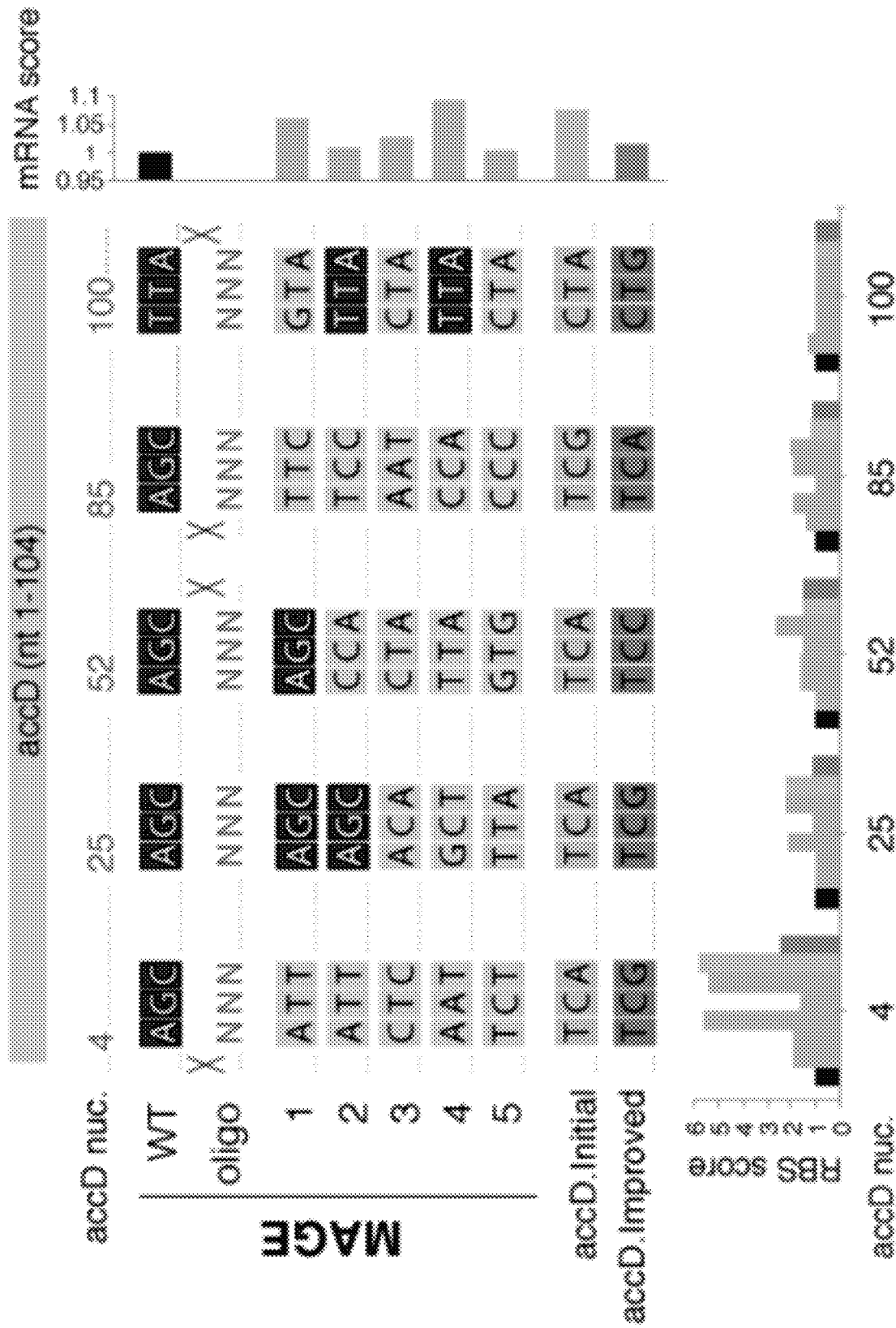
FIG. 16 illustrates an example of exploring viable alternatives for accD recoding. In order to locate the recalcitrant codon(s) in the recoded gene accD, MAGE (multiplexed automated genome engineering as is known in the art) (Wang et al., 2009) was used in a naive non-recoded strain. The N-terminal end of the gene that is the most probable loci for gene expression disruption was specifically targeted (Plotkin et al, 2011, Goodman et al., 2013, Boël et al., 2016). The first five forbidden codons of gene accD (nucleotide positions 4, 25, 52, 85, 100) were targeted by two oligonucleotides carrying degenerate bases at the recoded positions. (N represents base pairs A, T, C or G). WT represents non-recoded accD sequence (black), sequences 1-5 are viable genotypes resulting from MAGE experiment (forbidden codons shown in black), accD.Initial represents lethal recoded accD (yellow), accD.Improved represents an alternative computationally generated accD sequence. Predicted mRNA folding energy scores for each sequences are shown on the right. Predicted RBS strength scores for each codon are shown below (bars for each position are in the following order: WT (black); sequence 1-5 (gray); accD.Initial (yellow); accD.Improved (blue)). mRNA score represents the ratio between the predicted mRNA folding energy (kcal/mol) of the recoded sequence and the wild-type sequence. RBS score represents the ratio between the predicted RBS strength of the recoded sequence and the wild-type sequence for each codon. RBS strength is a calculated score used as a proxy for ribosome pausing.

Segment 44 was selected as a test case to develop a troubleshooting pipeline for solving design exceptions (FIGS. 15A-15B). As shown for gene accD, RBS strength and mRNA folding were first analyzed to pinpoint the most probable cause of disruption in gene expression (Plotkin et al., 2011, Goodman et al., 2013, Boël et al., 2016). Then, degenerate MAGE oligos were used to rapidly prototype viable alternative codons (FIG. 16). For calculating the mRNA secondary structure score, a sliding window of 40 bp around the codon of interest was used. The algorithm was further updated to score mRNA secondary structure as a skewed interval that is −30 to +100 nucleotides relative to the codon of interest. Notably, for codons in the first 100 nucleotides, the window was centered at the start of the gene.

Figure 17:
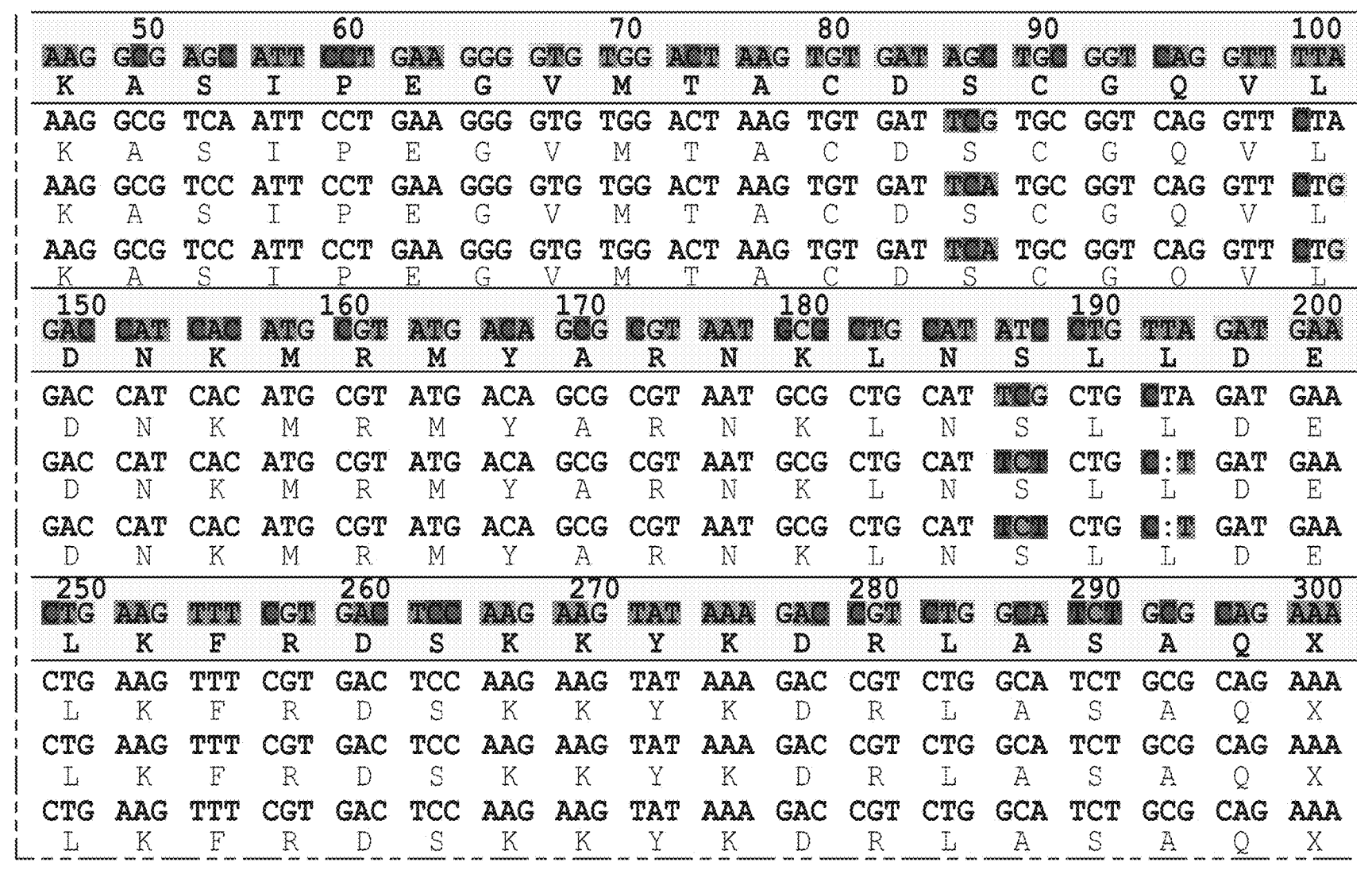
Figure 17:
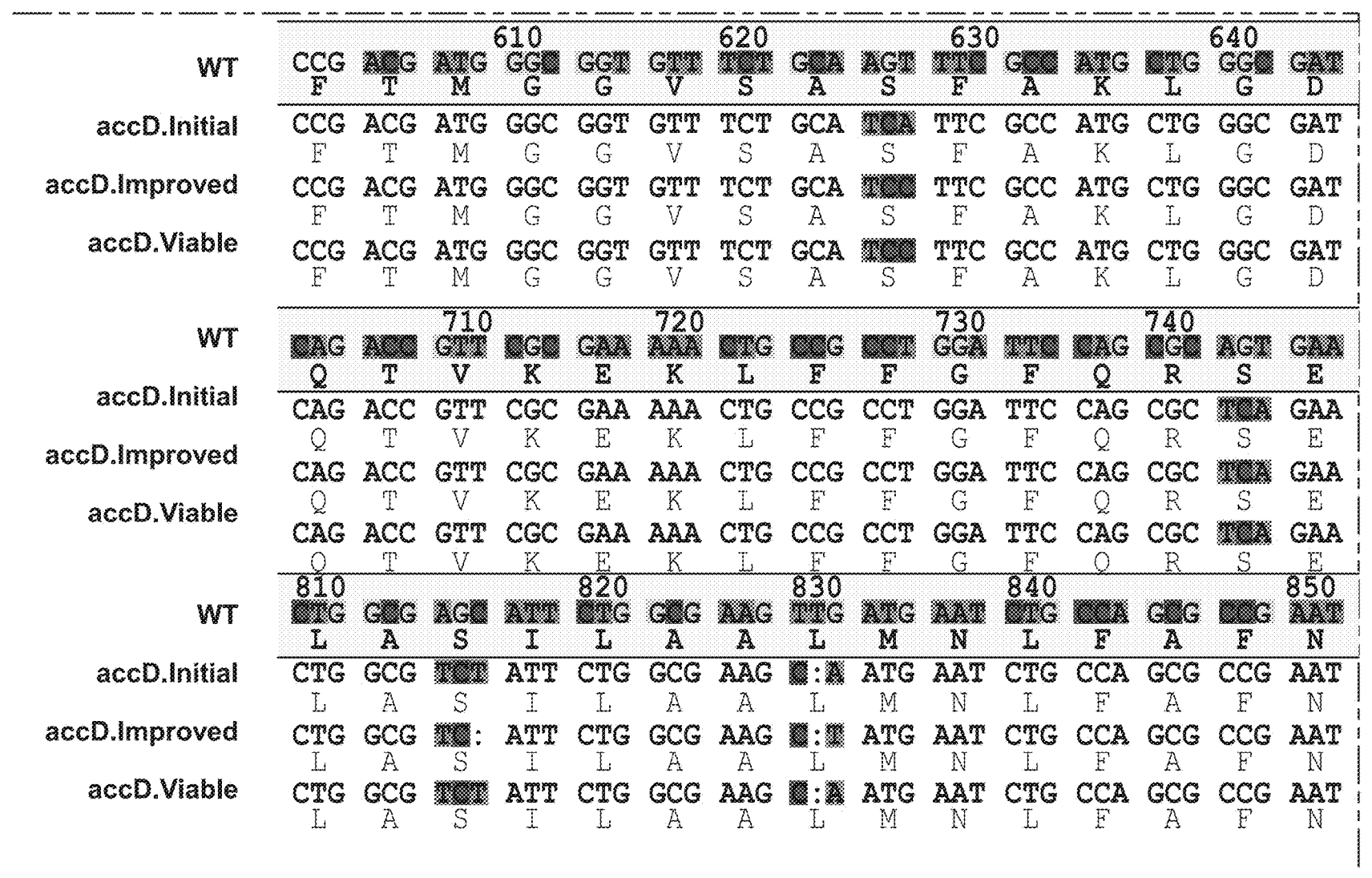
Figure 17:
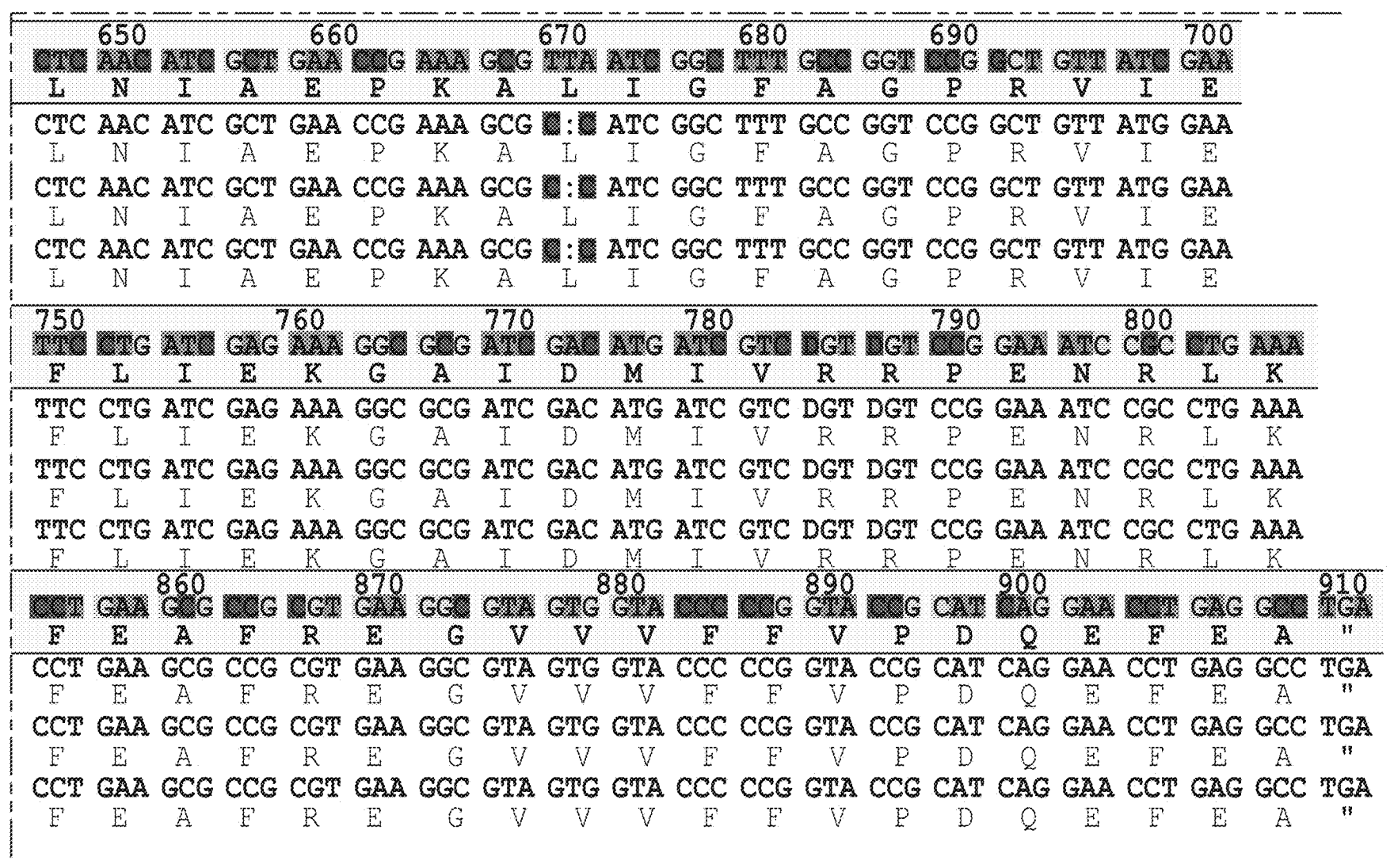

Finally, a new recoded sequence was computationally generated using more stringent mRNA and RBS scoring parameters (FIGS. 15A-15B, FIG. 17) and was introduced into the recoded segment via multiple cycles of lambda Red recombineering. Viable clones were selected by the subsequent chromosomal deletion.

In some cases, all viable clones carried a specific sequence of accD that had the N-terminal end of the improved design and the C-terminal end of the initial (lethal) design, highlighting the significance of N-terminal optimization for successful synonymous codon replacement (Kudla et al., 2009, Goodman et al., 2013). Furthermore, such recombination events, which are expected due to the high degree of homology between the two gene versions, effectively shuffle the sequences and increase the search space of viable recoded codons.

To further confirm adequate chromosomal expression, the recoded segment was integrated into the chromosome using λ-integrase. attP-specific Cas9-mediated DNA cleavage was then used to ablate all non-integrated plasmids, leaving a single integration event per genome. No fitness changes were observed upon segment integration (FIG. 13A-13B). Finally, DNA sequence analysis of all validated strains may suggest some degree of in vivo accumulation of mutations, which may be expected during strain engineering. Yet, to achieve complete genome recoding, non-lethal reversions and silent mutations may be corrected in the final strain using MAGE.

Figures 18A, 18B:
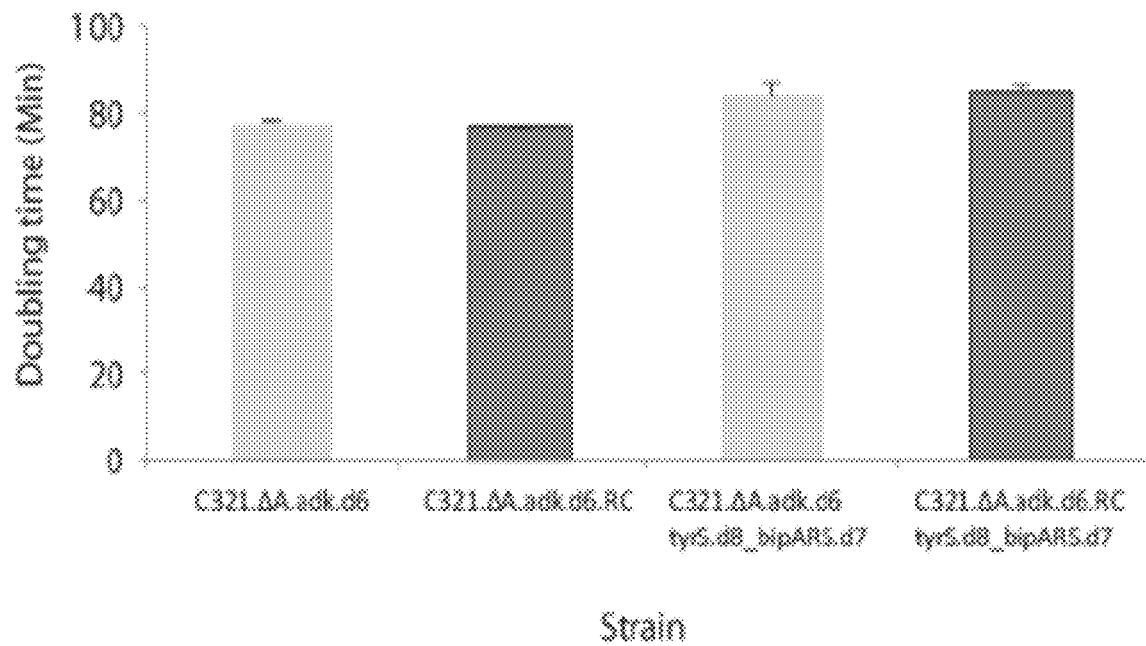
FIGS. 18A-18B illustrates examples showing compatibility of 57-codon adk gene with biocontainment. In order to verify rE. coli-57 compatibility with biocontainment, seven-codon replacement for the essential gene adk was applied in two different bio-contained strains (C321.ΔA.adk_d6 and C321.ΔA.adk_d6.tyrS_d8).

According to certain aspects, substantial modifications to both codon usage and tRNA anticodons may lead to instability of a reduced genetic code without proper selection to prevent codon reversion (Osawa et al., 1989); however, establishing functional dependence on the recoded state may both stabilize the modified genome and offer a stringent biocontainment mechanism (Marliere, 2009). As an example, a biocontained strain was developed in which all UAG codons were removed and two essential genes (adk and tyrS) were altered so that the strain required nsAAs to remain viable (Mandell et al., 2015). In order to determine whether the final rE coli-57 strain will support a similar biocontainment mechanism, the 57-codon versions of both adk and tyrS were confirmed to be functionally active in vivo. Moreover, it was found that recoded and nsAA-dependent adk gene has the same fitness and extremely low escape rates reported for the original strain (FIG. 18A-18B).

Even after all instances of forbidden codons are removed from the genome, the genetic code may remain unchanged until the genes for five tRNAs (argU, argW, serV, leuX, leuZ) and one release factor (prfA) are removed. Once rE coli-57 is fully recoded and these tRNAs are removed, the strain may be tested for novel properties such as resistance to viruses and horizontal gene transfer. Additionally, orthogonal aminoacyl-tRNA synthetase/tRNA pairs may be introduced to expand the genetic code by as many as 4 nsAAs.

Ultimately, the hierarchal, in vivo validation approach supported by robust design software, as described herein, may be utilized for large-scale synthetic genome construction and to radically change the genetic code. Genetically isolated and recoded genomes may expand synthetic functionality of living cells, offering a unique chassis for broad applications in biotechnology.

DNA Synthesis

DNA was synthesized by industrial partners Gen9, SGI-DNA, Twist Biosciences, Genewiz, and IDT DNA technologies. The synthesis pipeline was developed primarily with the aim of reducing synthesis cost and turnaround time, considering constraints of synthesis error rate and QC. Gen9 synthesized the majority of DNA, providing 3,960 kb as fragments ranging in size from 1.2-4.2 kb. Additional synthesis was provided by Twist Biosciences (30 kb in fragments ranging 1.4-2.0 kb) IDT (27 kb in fragments ranging 1.0-1.7 kb), and Genewiz (26 kb in fragments ranging 12.4-3.0 kb). An additional 328 kb (SGI-DNA), 36 kb (Twist), and 6 kb (Gen9) were synthesized, but were not used in the final genome segment syntheses.

PCR Amplification of Synthetic DNA

All synthetic DNA was PCR amplified and purified prior to assembly. 30 μL of PCR reaction was prepared as follows; 1 μL of diluted template DNA (1 μL synthetic template DNA (synDNA) ranging 1 to 5 ng/μL, diluted in 9 μL TE buffer), 2 μL of primer mix (10 μM each primer, mixed in 50 μL of TE buffer), 15 μL of 2× SeqAmp DNA polymerase (Clontech Laboratories, Inc.), and 15 μL of PCR grade water. PCR cycles: 95° C. —1 minute, 98° C. —10 seconds, 60° C. —15 seconds, 68° C. —2 minutes, 35 cycles. 1% agarose gel was used to analyze 1 μL of PCR product. Optimization of unsuccessful PCR was done using 2× KAPA-HiFi DNA polymerase (Kapa Biosystems). 30 μL of PCR reaction was as follows; 1 μL of diluted template DNA (as above), 2 μL of primer mix (as above), 15 μL of 2× KAPA-HiFi, and 12 μL of PCR grade water. PCR cycles: 95° C. —1 minute, 98° C. —20 seconds, 60° C. —15 seconds, 72° C. —2 minutes, for 30 or 35 cycles. PCR products were gel purified using 2% E-gel Ex (Thermo Fisher Scientific Inc.).

Segment Assembly in S. cerevisiae

For segment assembly, GeneArt High-Order Genetic Assembly System (Life Technologies) was used with modifications. The vector pYES1L was modified to include restriction sites EcoRI and BamHI used for linearization, and a S. cerevisiae uracil selective marker was added to the vector backbone (termed 'pYES1L-URA'). Vector digestion was performed with both enzymes as follows: 5 hours at 37° C., followed by 20 minutes enzyme inactivation at 65° C. and 30 minute End Repair Module (NEB) treatment at 20° C. Linear vector was purified (Zymo DNA Clean & Concentrator) and size verified on DNA gel prior to use. Amplified synthetic fragment (400 ng of each) were mixed and purified for each assembly reaction (10-15 fragments used for each assembly), then added with 100 ng of purified linear vector pYES1L-URA. Vector/fragment DNA mix was concentrated using SAVANT DNA 120 SpeedVac concentrator (Thermo Fisher Scientific Inc.) to ~10 μL in volume.

Transformation of MaV203 competent cells was performed according to manufacturer instructions. Cells were plated on CM glucose media without tryptophan and incubated at 30° C. for 3 days. Colony PCR was used to screen for segment assembly; yeast colony was lysed in 15 μL of 0.02 M NaOH, boiled for 5 minutes at 95° C. and kept on ice for 5 minutes, followed by dilution with 40 μL ddH2O.

1.5 µL of the mix was used as template for multiplex PCR using KAPA2G multiplex polymerase (KAPA Biosystems) and the following PCR conditions: 98° C. —5 minute, 98° C. —30 seconds, 62° C. —30 seconds, 72° C. —30 seconds, 72° C. —5 minutes (32 cycles). Only colonies showing positive PCR were used. For *E. coli* transformation, cells were lysed in 15 µL 0.02 M NaOH, vortexed with glass beads for 5 minutes and placed on ice. 1.5 µL of the lysis mix was added to electrocompetent TOP10 cells (Thermo Fisher Scientific), immediately electroporated (1.8 kV, 25 µFarads, 200Ω), and recovered for 1 hour at 37° C. before plating on spectinomycin selective plates.

*E. coli* Methods—Strains & Culture

TOP10 electrocompetent *E. coli* (Thermo Fisher Scientific) were used for the entire process for all segments except segments 19, 22, 23, 43, 44, 47 that were performed in BW38028 (Conway et al., 2014). EcM2.1 naïve strains were used for troubleshooting (EcM2.1 is a strain optimized for MAGE—*Escherichia coli* MG1655 mutS_mut dnaG_Q576A exoX_mut xonA_mut xseA_mut1255700::tolQRA Δ(ybhB-bioAB)::[λcI857 N(cro-ea59)::tetR-bla]) (Gregg et al., 2014).

Liquid culture medium consisted of the Lennox formulation of Lysogeny broth (LBL; 1% w/v bacto tryptone, 0.5% w/v yeast extract, 0.5% w/v sodium chloride) with appropriate selective agents: spectinomycin (95 µg/mL), chloramphenicol (50 µg/mL), kanamycin (30 µg/mL), carbenicillin (50 µg/mL), zeocin (10 µg/mL). Solid culture medium consisted of LBL autoclaved with 1.5% w/v Bacto agar (Thermo Fisher Scientific), containing the same concentrations of antibiotics as necessary.

Plasmid Transformation, Lambda Red Recombinations, MAGE

TOP10 and BW38028 (Conway et al., 2014) cells transformed with pYES1L-URA plasmid were the subject of all pipeline strain engineering. The average copy number for recoded segment on vector pYES1L-URA was found to be 1.8 plasmids/genome.

Knockout of the homologous chromosomal non recoded segment sequence is achieved by lambda Red recombineering specifically targeted to the genomic locus. 50 bp homology arms of the kanamycin cassette deletion are targeted to both sides of the genomic segment, which are different in sequence than the two sides of the plasmid carrying recoded segment. Therefore, the cassette specifically replaces the genomic segment.

All cells were transformed with pKD78 plasmid (Datsenko et al., 2000) to introduce the lambda Red recombineering machinery. Recombinase expression was induced for 2 hrs in Arabinose (2 ug/ml) followed by DNA transformation, using either double-stranded PCR products or MAGE oligonucleotides. Notably, all kanamycin cassette deletions were performed with 100 ng double-stranded PCR products. Each recombination was paired with a negative control (deionized water) to monitor kanamycin selection performance. Other recombineering experiments were carried out as described previously (Wang et al., 2009), and total oligo pool was adjusted to a maximum of 5 µM. After 3 hrs of recovery at 34° C., the cells were plated in permissive media (for MAGE) or selective media (e.g. kanamycin) and incubated overnight at 34° C. The amount of cells plated was ~10³ for MAGE experiments, ~10⁷ for plasmid transformations and ~10⁸ for kanamycin cassette deletions. Resulting strains were then subjected to verification by PCR.

Oligonucleotides, Polymerase Chain Reaction

A complete table of PCR oligonucleotides and primers can be found in Tables 3 and 4. PCR products used in recombination or for Sanger sequencing were amplified with Kapa 2G Fast polymerase according to manufacturer's standard protocols. Multiplex allele-specific PCR (mascPCR) was used for multiplexed genotyping using the KAPA2G Fast Multiplex PCR Kit, according to previous methods (Isaacs et al., 2011). Primers for mascPCR were designed using an automated software specially built for this purpose. Sanger sequencing reactions were carried out through a third party (Genewiz). mascPCR screening was performed after the pKD78 transformation, kanamycin deletion, attP-zeocin insertion and λ-Integration steps.

Genome Integration of Recoded Segments

λ-integrase was used for integration of recoded segment plasmid into *E. coli* genome (Haldimann et al., 2001). attP site was added to the segment vector by lambda-red recombineering, along with zeocin resistance marker. Then, λ-integrase was heat-induced for 6 hours at 42° C., and cells were plated on spectinomycin and kanamycin plates for screening. PCR screening was performed using attP and attB specific primers (attB-seq-f: CAG GGA TGC AAA ATA GTG TTG AG (SEQ ID NO: 2326); attB-segr: GA GAA GTC CGC GTG AGG (SEQ ID NO: 2327); attP-f. GCGCTAATGCTCTGTTACAG (SEQ ID NO: 2328); attP-r:GAAATCAAATAATGATTTTATTTT GACTGA (SEQ ID NO: 2329)) as well as allele-specific primers (Table 4) to identify clones with correct plasmid integration.

Cas9-Induced Vector Elimination

Once integrated, a further validation step was taken to ensure no additional copies of the recoded segments remain in the cell. Before chromosomal integration, all recoded segment plasmids contain an attP site for λ-integration. Since λ-integration modifies the attP sequence upon genome integration into attB site, only non-integrated plasmids carry intact attP sequence. Residual copies of the plasmid were eliminated using attP-specific Cas9-targeting (FIG. 10C) (Esvelt et al., 2013), such that SpCas9 protein induces double stranded breaks in all episomal (non-integrated) segment plasmids. Linearized remaining plasmids are then digested, and the resulting strains are plasmid-free.

Specifically, a plasmid containing the SpCas9 protein gene was constructed as well as a tracrRNA and a guide RNA directed towards the unmodified attP sequence (Plasmid details (DS-SPcas, Addgene plasmid 48645): cloDF13 origin, carb, proC promoter, SPcas9, tracrRNA (with native promoter and terminator), J23100 promoter, 1 repeat (added to facilitate cloning in a spacer onto the same plasmid). The guide RNA sequence cloned in the spacer is: TCAGCTTTTTTATACTAAGT (SEQ ID NO: 2330). Plasmid was transformed and cells were plated 3 hrs after transformation for growth at 37° C. under selection for SpCas9 plasmid (carbenicillin) (~10⁷ cells). Resulting cells were PCR-verified for loss of all attP sequence. Presence of the integrated vector carrying recoded segment was confirmed by mAsPCR.

Fitness Measurements

Strain doubling time was calculated as previously described (Lajoie et al., 2013b). Briefly, cultures were grown in flat-bottom 96-well plates (150 µL LBL, 34° C., 300 r.p.m.). Kinetic growth (OD600) was monitored on a Biotek Eon Microplate reader with orbital shaking at 365 cpm at 34° C. overnight and at 5-min intervals. Doubling times were calculated by t=Δt×ln(2)/m, where Δt=5 min per time point and m is the maximum slope of ln(OD600) calculated by linear regression of a sliding window of 5 contiguous time points (20 min intervals). Analysis was performed using a Matlab® script.

The average change decrease in fitness observed for all 44 segments is 15% relative to the parental non-recoded strain fitness. 75% of segments (33 segments) were observed to have <20% decrease in fitness relative to wild-type, and only 4% of segments (2 segments) were observed to have more than 50% decrease in fitness (segments 21, 84), which may be referred to as "substantial decrease."

Investigation of Severe Fitness Impairment

A fitness impairing recoded gene was defined when deletion of the gene resulted in a reduced doubling time relative to the parent. This suggests the recoded gene was not well expressed. Impaired genes were located by gradually deleting each chromosomal gene using lambda Red recombineering and by measuring doubling times after each deletion (FIG. 12A-12B). Once located, a fitness impairing recoded gene is addressed using a troubleshooting pipeline.

First, the gene was Sanger-sequenced with allele-specific primers which prime only on the recoded, not the wild-type sequence. Sequencing results were analyzed to decide on one of two troubleshooting routes:

1) Sequencing revealed a mutation causing fitness impairment. Specifically, these refer to mutations that are not included in the computational genome design. Those mutations were fixed using MAGE.

2) No mutations were identified in the sequence compared to computational design. The fitness impairment of the recoded gene was assumed to originate in the recoded codons.

FIG. 12A-12B (segment 21) illustrates the troubleshooting strategy. Potential deleterious codons were identified in both the fitness impairing gene (fabH) and in the promoter of the entire operon (3 recoded codons located in upstream gene yceD). MAGE was performed (Wang et al., 2009) in a naïve strain (EcM2.1 (Gregg et al., 2014)) with oligos corresponding to the original recoded scheme to find fitness impairing codons. After 3 cycles of MAGE, cells were plated on permissive media (~103 cells). 96 clones were screened with mascPCR primers targeting the wild-type sequence. The doubling time of clones having incorporated recoded codons was measured (~20). No significant fitness impairment was observed for codons changed in gene fabH. Thus, the original design changes in the promoter were identified as the troublesome change. MAGE was performed in a naïve strain using degenerate MAGE oligos. After 3 cycles of MAGE, cells were plated on permissive media ($10^3$ cells). An alternative recoded design without any forbidden codons was identified.

Biocontainment Assay

The most effective biocontainment strategy involving recoded organisms (Mandell et al., 2015) uses 3 genes that are redesigned to accommodate a non-standard-amino-acid: the tyrosyl-tRNA-synthetase (tyrS), the adenylate kinase (adk) and the biphenylalanyl-tRNA syntethase (bipARS). Confirmation that those redesigned genes are compatible with the recoding strategy is critical for assaying the biocontainment potential of the recoded strain.

The bipARS gene does not contain any of the seven forbidden codons and thus considered compatible and can be integrated into the recoded strain. The gene adk, which contains only 1 forbidden codon and 2 additional adjustment mutations, was recoded and further validated in a biocontained strain. The gene tyrS, which contains multiple forbidden codons, was recoded successfully in the current study, but the recoded tyrS was not yet tested in the biocontainment strategy.

Strains used in this study have the following background: All strains were based on EcNR2 (*Escherichia coli* MG1655 ΔmutS::cat Δ(ybhBbioAB)::[λcI857 N(cro-ea59)::tetR-bla]). Strains C321 [strain 48999] and C321.ΔA [strain 48998] are available from Addgene. C321.ΔA.adk_d6 and C321.ΔA.adk.d6_tyrS.d8_bipARS.d7 are based on (Mandell et al., 2015).

Using MAGE, the 3 codon changes in adk were included in the biocontained strain C321.ΔA.adk.d6 (escape rate around 10-6) and adk.d6_tyrS.d8_bipARS.d7 (most biocontained strain with escape rate <10-12). Fitness of the resulting strains (C321.ΔA.adk.d6.rc and C321.ΔA.adk.d6.rc tyrS.d8_bipARS.d7) was evaluated as presented above. Escape frequencies were measured as previously described (Mandell et al., 2015).

Briefly, all strains were grown in permissive conditions and harvested in late exponential phase. Cells were washed twice in LBL and resuspended in LBL. Viable cfu was calculated from the mean and standard error of the mean (s.e.m.) of three technical replicates of tenfold serial dilutions on permissive media. Three technical replicates were plated on non-permissive media and monitored for 7 days (~$10^7$ cells). Two different non-permissive media conditions were used: SC, LBL with SDS and chloramphenicol; and SCA, LBL with SDS, chloramphenicol and 0.2% arabinose.

DNA and RNA Sequencing Methods—Genome Sequencing

Bacterial genomic DNA was purified from 1 mL overnight cultures using the Illustra Bacteria GenomicPrep Spin Kit (General Electrics), and libraries were constructed using the Nextera DNA library Prep (Illumina), or the NebNext library prep (New England Biolabs). Libraries were sequenced using a MiSeq instrument (Illumina) with PE250 V2 kits (Illumina).

SNP Calling

Two different pipelines were used to analyze genomes. Breseq (Deatherage, 2014) which supports haploid genome analysis, was used for SNP and short indels calling for strains with only one version of the segment (i.e. recoded or non-recoded wild-type). Breseq was used with default parameters.

RNAseq Methods

RNA was prepared from strains carrying an episomal copy of the recoded segment and deletion of the chromosomal segment. RNA was stabilized using RNAprotect (QIAGEN), and extracted with miRNeasy kit (QIAGEN).

rRNA content was reduced using riboZero rRNA Removal Kit (Illumina). RNAseq libraries were constructed using the Truseq Stranded mRNA Library Kit (Illumina). Libraries were sequenced using a MiSeq instrument (Illumina) with PE150 V2 kits (Illumina).

RNAseq Analysis

FASTQ files obtained from RNAseq experiments were mapped using BWA (Li et al., 2009a) using default parameters, and processed (indexing, sorting) using SAMTOOLs (Li et al., 2009b) to generate a bam file for each sample. Custom R scripting was used to analyze the data. The library GenomicFeatures (Bioconductor) was used to associate reads to genes, and the Bioconductor library DESeq (Anders et al., 2010) was used to perform differential expression analysis. Genes with an absolute log 2 fold change higher than 2, and adjusted p-value smaller than 0.01 were classified as differentially expressed genes. Specifically, partially recoded strains and TOP10 control were individually analyzed by RNA-Seq. The expression of each gene was then compared using DESeq2 (Anders et al., 2010) in each sample (recoded or non recoded) to the expression of the same gene in every other sample (5 independent segments) to get a representative range of gene expression across all samples. For example, expression level for gene folC in segment 44 was measured in recoded segment 44 (only recoded copy), in TOP10 (only wild-type copy) and in all other partially recoded strains (where segment 44 is not recoded, e.g. only wild-type copy of gene folC).

Example II

Rules for Codon Choice—Editing Rare Arginine Codons in *E. coli*

According to some aspects, methods are described herein for empirical validation and updating of rules or constraints or conditions or parameters or features for genome design. In particular, the rare arginine codons AGA and AGG (AGR) present a case study in codon choice, with AGRs encoding important transcriptional and translational properties distinct from the other synonymous alternatives (CGN). A strain of *Escherichia coli* has been created in which all 123 instances of AGR codons have been removed from all essential genes. 110 AGR codons were replaced with the synonymous CGU, whereas the remaining 13 AGRs necessitated diversification to identify viable alternatives. Successful replacement codons tended to conserve local ribosomal binding site-like motifs and local mRNA secondary structure, sometimes at the expense of amino acid identity. Based on these observations, metrics were empirically defined for a multi-dimensional 'safe replacement zone' (SRZ) within which alternative codons may be more likely to be viable. To further evaluate synonymous and non-synonymous alternatives to essential AGRs, a CRISPR/Cas9-based method was implemented to deplete a diversified population of a wild type allele, in which the method allowed for a comprehensive evaluation of the fitness impact of all 64 codon alternatives. Using this method, relevance of the SRZ was confirmed by tracking codon fitness over time in 14 different genes. It was found that codons that fall outside the SRZ may be rapidly depleted from a growing population.

Ultimately, the genetic code possesses inherent redundancy (Crick, 1963), with up to six different codons specifying a single amino acid. This implies that synonymous codons are equivalent (Kimura, 1977), however most prokaryotes and many eukaryotes (dos Reis et al., 2004; Newton and Wernisch, 2014) display a strong preference for certain codons over synonymous alternatives (Hershberg and Petrov, 2008; Plotkin and Kudla, 2011). While different species have evolved to prefer different codons, codon bias is largely consistent within each species (Hershberg and Petrov, 2008). However, within a given genome, codon bias differs among individual genes according to codon position, suggesting that codon choice has functional consequences. For example, rare codons are enriched at the beginning of essential genes (Chen and Inouye, 1990; Chen and Inouye, 1994), and codon usage strongly affects protein levels (Kane, 1995; Sharp and Li, 1987; Sharp et al., 1993), especially at the N-terminus (Goodman et al., 2013). This suggests that codon usage plays a poorly understood role in regulating protein expression.

Several hypotheses attempt to explain how codon usage mediates this effect, including but not limited to: facilitating ribosomal pausing early in translation to optimize protein folding (Zhou et al., 2013), adjusting mRNA secondary structure to optimize translation initiation or modulate mRNA degradation, preventing ribosome stalling by co-evolving with tRNAs levels (Plotkin and Kudla, 2011), providing a "translational ramp" for proper ribosome spacing and effective translation (Tuller et al., 2010), or providing a layer of translational regulation for independent control of each gene in an operon (Li, 2015). Additionally, codon usage may impact translational fidelity (Hooper and Berg, 2000), and the proteome may be tuned by fine control of the decoding tRNA pools (Gingold et al., 2014). Although Quax et al. provides an excellent review of how biology chooses codons, systematic and exhaustive studies of codon choice in whole genomes are lacking (Quax et al., 2015). Studies have only begun to probe the effects of codon choice in a relatively small number of genes (Goodman et al., 2013; Isaacs et al., 2011; Kudla et al., 2009; Lajoie et al., 2013a; Li et al., 2012). Furthermore, although the UAG stop codon has been completely removed from *Escherichia coli* (Lajoie 2013a), and the AGG codon has been ambiguously reassigned (Lee et al., 2015; Mukai et al., 2015; Zeng et al., 2014), no genome wide attempt to entirely replace a sense codon has been reported. Prior work has established there are unknown constraints to such replacement (Isaacs et al., 2011; Lajoie et al., 2013a; Lajoie et al., 2013b). Attempting to replace all essential instances of a codon in a single strain would provide valuable insight into these constraints. Additionally, while some constraints are known to exist in certain genes, no attempt has been made to explore the breakdown of synonymous codons on a genome wide scale.

As described in the Example herein, rare arginine codons AGA and AGG (comprising AGR according to IUPAC conventions) were chosen for this study because the literature suggests that they are among the most difficult codons to replace and that their similarity to ribosome binding sequences underlies important non-coding functions (Chen and Inouye, 1990, Rosenberg et al., 1993, Spanjaard et al., 1988, Spanjaard et al., 1990, Bonekamp et al., 1985. Furthermore, their sparse usage (123 instances in the essential genes of *E. coli* MG1655 and 4228 instances in the entire genome (Table 3) made replacing all AGR instances in essential genes a tractable goal, with essential genes serving as a stringent test set for identifying any fitness impact from codon replacement (Baba, et al., 2006). Additionally, recent work has shown the difficulty of directly mutating some AGR codons to other synonymous codons (Zeng, et al, 2014), although the authors do not explain the mechanism of failure or report successful implementation of alternative designs. All 123 instances of AGR codons were attempted to be removed from essential genes by replacing them with the synonymous CGU codon. CGU was chosen to maximally disrupt the primary nucleic acid sequence (AGR→CGU). It was hypothesized that this strategy would maximize design flaws, thereby revealing rules for designing genomes with reassigned genetic codes. Importantly, individual codon target were not inspected a priori in order to ensure an unbiased empirical search for design flaws.

Figure 19A:
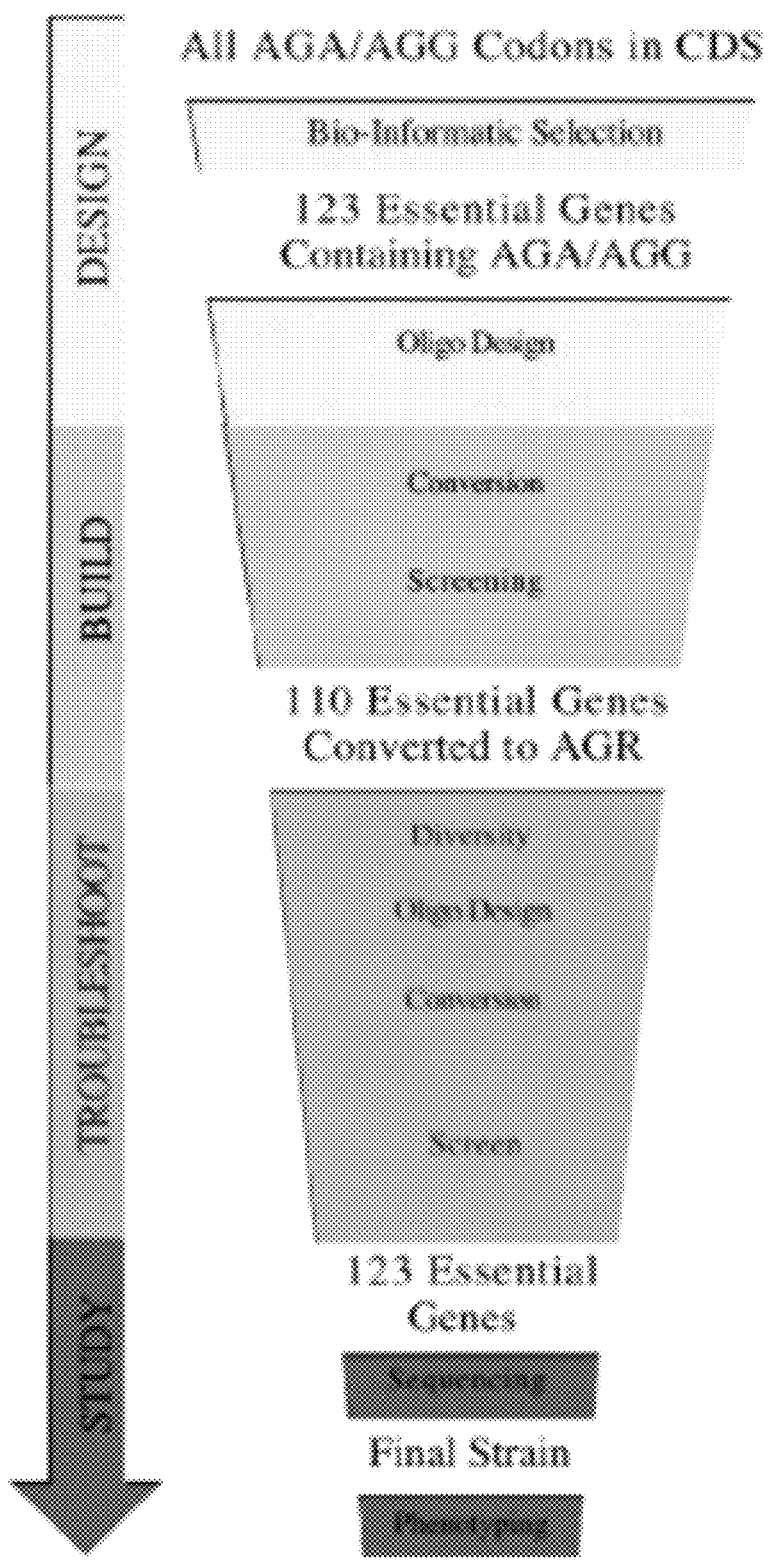
FIGS. 19A-19B illustrate an example of construction of strain C123.

To construct this modified genome, co-selection multiplex automatable genome engineering (CoS-MAGE) was used (Carr et al., 2012, Gregg et al., 2014) to create an *E. coli* strain (C123) with all 123 AGR codons removed from its essential genes (FIG. 19A). CoS-MAGE leverages lambda red-mediated recombination (Yu et al., 2000, Ellis et al., 2001) and exploits the linkage between a mutation in a selectable allele (e.g. tolC) to nearby edits of interest (e.g., AGR conversions), thereby enriching for cells with those edits (FIG. S1). To streamline C123 construction, *E. coli* strain EcM2.1 was chosen to start with, in which the strain was previously optimized for efficient lambda red-mediated genome engineering (Gregg et al., 2014, Lajoie et al., 2012). Using CoS-MAGE on EcM2.1 improves allele replacement frequency by 10-fold over MAGE in non-optimized strains but performs optimally when all edits are on the same replichore and within 500 kilobases of the selectable allele (Gregg et al., 2014). To accommodate this requirement, the genome was divided into 12 segments containing all 123 AGR codons in essential genes. A tolC cassette was moved around the genome to enable CoS-MAGE in each segment, allowing us to rapidly prototype each set of AGR→CGU mutations across large cell populations in vivo. Of the 123 AGR codons in essential genes, 110 could be changed to CGU by this process (FIG. 1), revealing considerable flexibility of codon usage for most essential genes. Allele replacement (in this case, AGR→CGU codon substitution) frequency varied widely across these 110 permissive codons, with no clear correlation between allele replacement frequency and normalized position of the AGR codon in a gene (FIG. 2A).

Figure 19B:
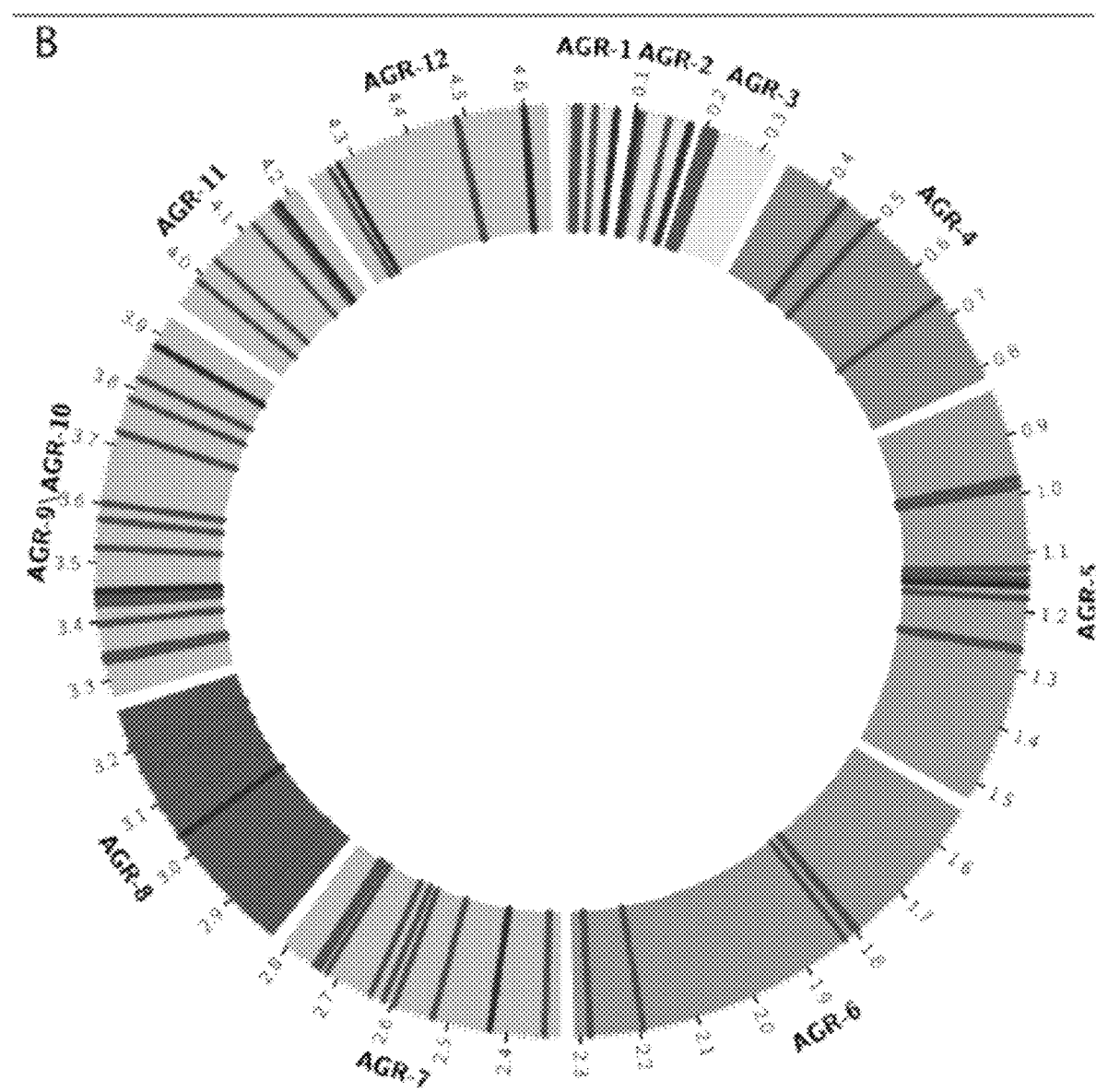
Figure 20A:
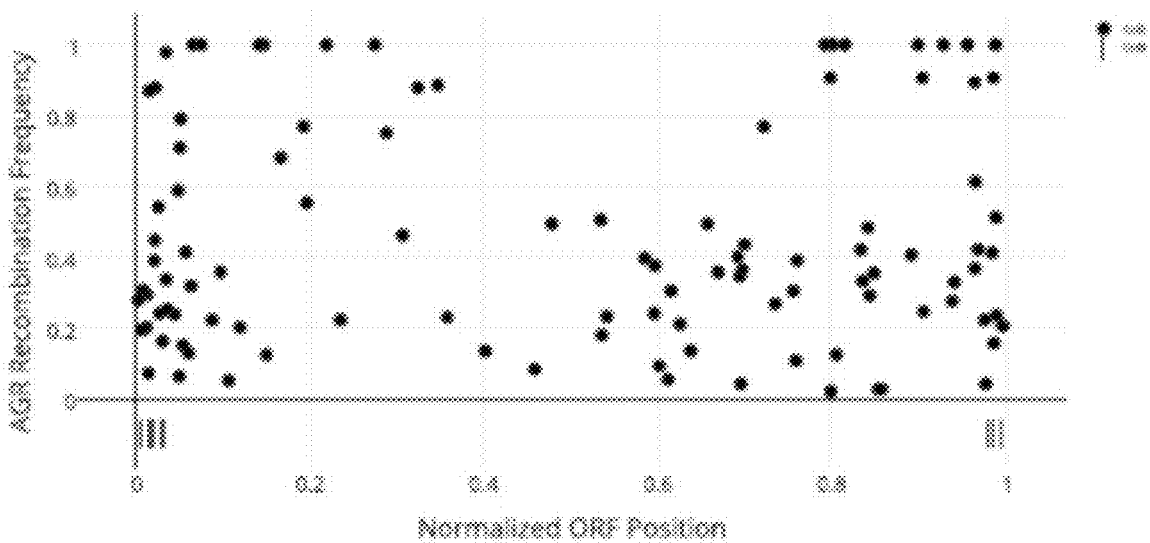
Figure 21A:
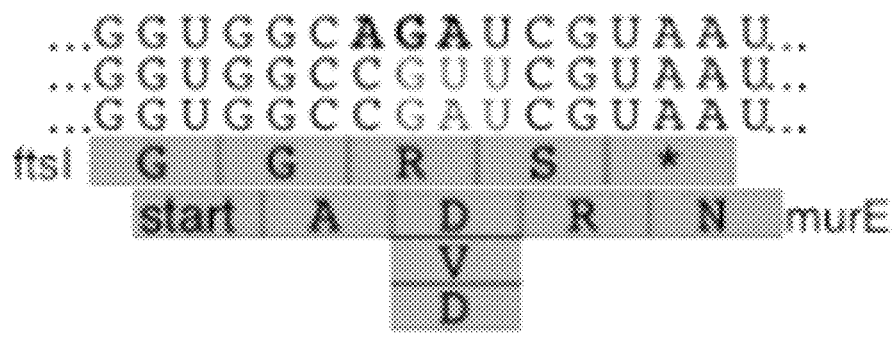
FIGS. 21A-21D illustrate examples of failure mechanisms for four recalcitrant AGR replacements. Wild type AGR codons are indicated in bold black letters, design flaws are indicated in red letters, and optimized replacement genotypes are indicated in green letters.

The remaining 13 AGR→CGU mutations were not observed, suggesting a codon substitution frequency of less than the detection limit of 1% of the bacterial population. These 'recalcitrant codons' were assumed to be deleterious or non-recombinogenic and were triaged into a troubleshooting pipeline for further analysis (FIG. 19A-B). Interestingly, all except for one of the thirteen recalcitrant codons were co-localized near the termini of their respective genes, suggesting the importance of codon choice at these positions—seven were at most 30 nt downstream of the start codon, while five were at most 30 nucleotides (nt) upstream of the stop codon (FIG. 20A, lower panel). These failed AGR→CGU mutations were inspected for obvious design errors. For example, ftsI_AGA1759 overlaps the second and third codons of murE, an essential gene, introducing a missense mutation (murk D3V) that may impair fitness. Replacing ftsI_AGA with CGA successfully replaced the forbidden AGA codon while conserving the primary amino acid sequence of MurE with a minimal impact on fitness (FIG. 21A). Similarly, holB_AGA4 overlaps the upstream essential gene tmk, and replacing AGA with CGU converts the tmk stop codon to Cys, adding 14 amino acids to the Cterminus of tmk. While some C-terminal extensions are well-tolerated in *E. coli* (Ohtake et al., 2012), extending tmk appears to be deleterious. holB_AGA was successfully with CGC by inserting three nucleotides comprising a stop codon before the holB start codon. This reduced the tmk/holB overlap, and preserved the coding sequences of both genes (FIG. 27A).

Figure 21B:
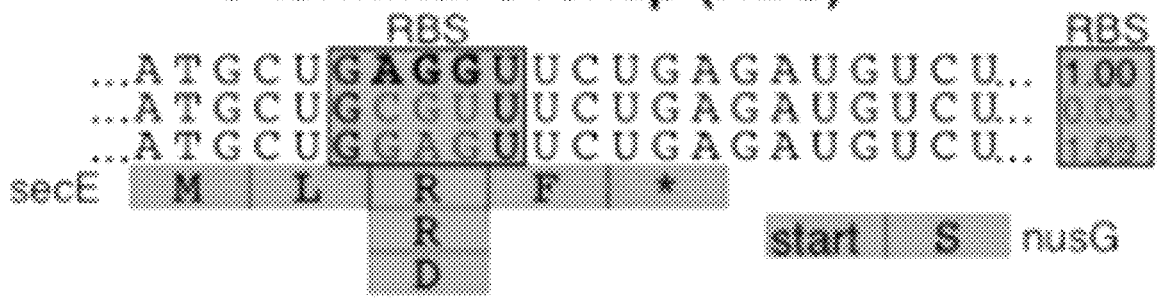

Subtler overlap errors were identified for the four remaining C-terminal failures, where it was determined that AGR→CGU mutations disrupt RBS motifs belonging to downstream genes (secE_AGG376 for nusG, dnaT_AGA532 for dnaC, and folC AGAAGG1249,1252 for dedD, the latter constituting two codons). Both nusG and dnaC are essential, suggesting that replacing AGR with CGU in secE and dnaT lethally disrupts translation initiation and thus expression of the overlapping nusG and dnaC (FIG. 21B and FIG. 27B). Although dedD is annotated as non-essential (Baba, et al., 2006), it was hypothesized that replacing the AGR with CGU in folC disrupted a portion of dedD that is essential to the survival of EcM2.1 (*E. coli* K-12). In support of this hypothesis, the 29 nucleotides of dedD that were not deleted by Baba et al. (Baba, et al., 2006) were not deleted and did not overlap with folC, suggesting that this sequence is essential in the strains described. The unexpected failure of this conversion highlights the challenge of predicting design flaws even in well-annotated organisms. Consistent with the observation that disrupting these RBS motifs underlies the failed AGR→CGU conversions, all three design flaws were overcome by selecting codons that conserved RBS strength, including a non-synonymous (Arg→Gly) conversion for secE.

Figure 21C:
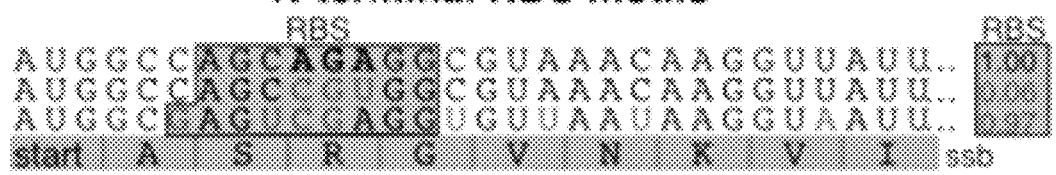

These lessons, together with previous observations that ribosomes pause during translation when they encounter ribosome binding site motifs in coding DNA sequences (Li et al., 2012), provided key insights into the N-terminal AGR→CGU failures. As described herein, RBS-like motifs may refer to both RBS motifs (which may typically occur before a start codon) and similar motifs (which may occur in the open reading frame but do not necessarily cause translation initiation). Three of the N-terminal failures (ssb_AGA10, dnaT_AGA10 and prfB_AGG64) had RBS-like motifs either disrupted or created by CGU replacement. While prfB_AGG64 is part of the ribosomal binding site motif that triggers an essential frameshift mutation in prfB (Lajoie et al., 2013a, Craigen et al., 1985, Curran et al., 1993), pausing-motif-mediated regulation of ssb and dnaT expression has not been reported. Nevertheless, ribosomal pausing data (Li et al., 2012) showed that ribosomal occupancy peaks are present directly downstream of the AGR codons for ssb and absent for dnaT (FIG. 28); meanwhile, unsuccessful CGU mutations were predicted to weaken the RBS-like motif for prfB and ssb and strengthen the RBS-like motif for dnaT (FIG. 21C and FIG. 27C), suggesting a functional relationship between RBS occupancy and cell fitness.

Figure 22:
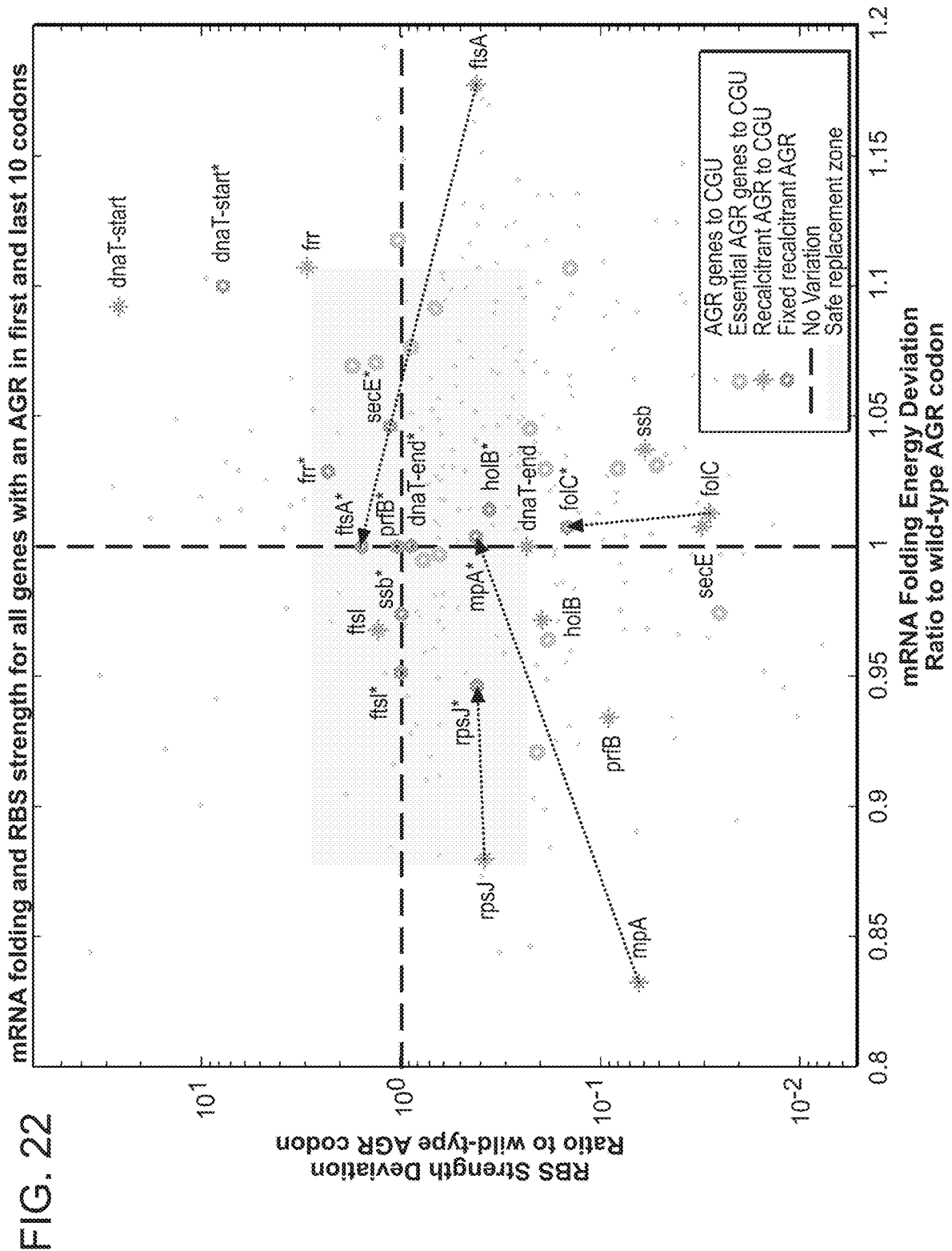
FIG. 22 illustrates an example of RBS strength and mRNA structure predict synonymous mutation success. In particular.
Figure 27C:
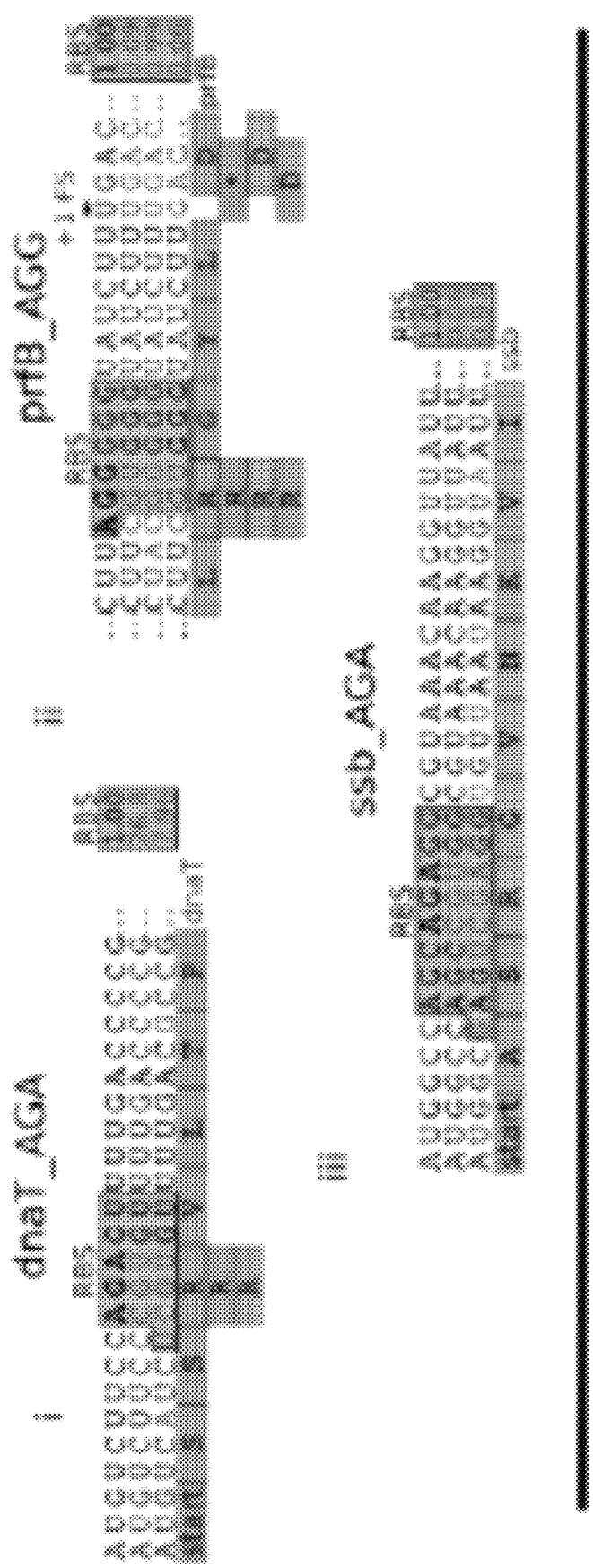
Figure 28:
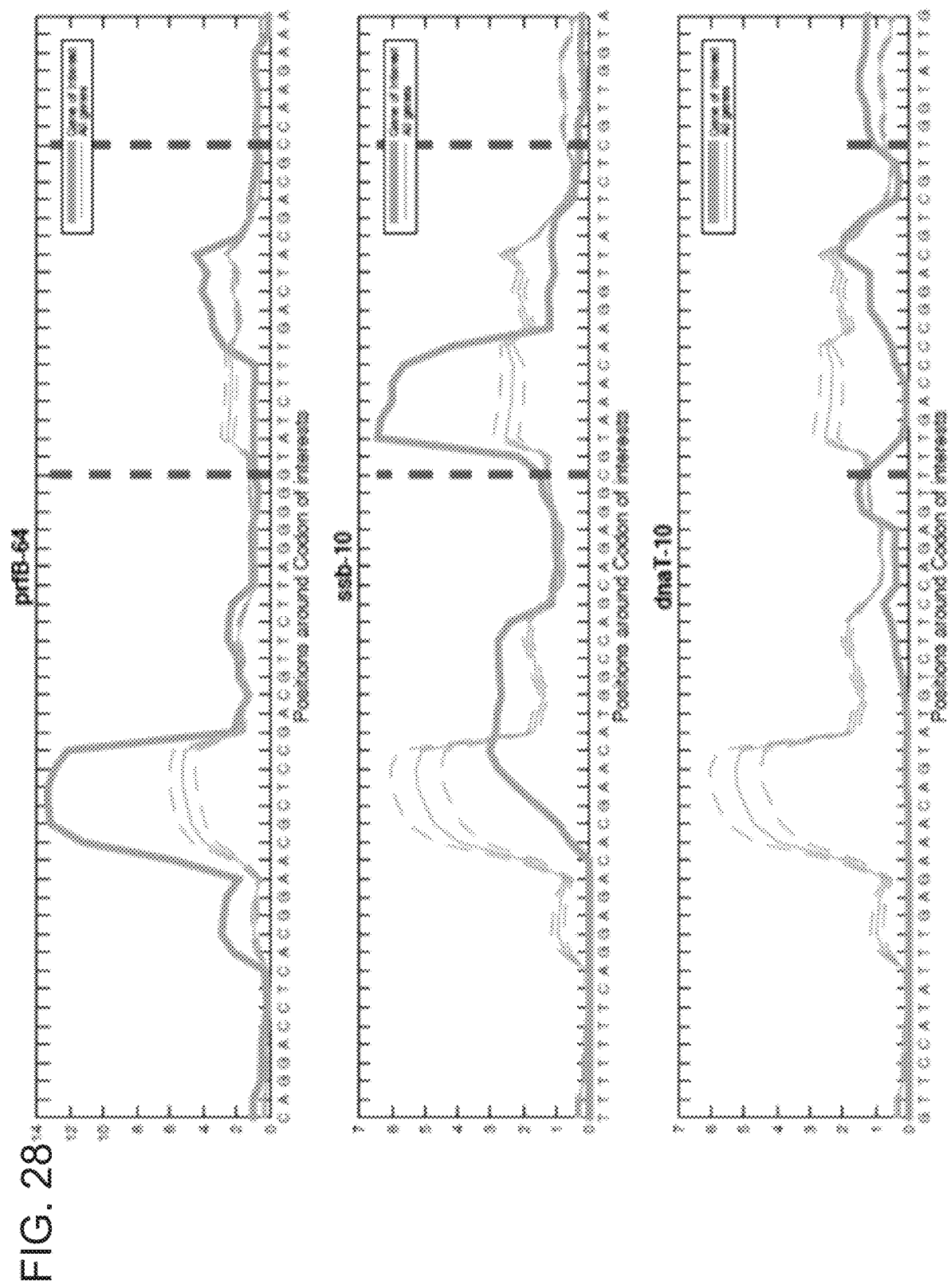
FIG. 28 illustrates an example of ribosomal pausing data drawn from previous work (Li et al., 2012) for genes ssb (SEQ ID NO: 2324), dnaT (SEQ ID NO: 2325) and prfB (SEQ ID NO: 2323). Green line represents ribosome profiling data for each gene. Orange line is the average for all genes with an AGR codon within the first 30 nucleotides of the annotated start codon. Region between the two vertical red lines indicates zones of interest (centered 12 bp after the AGR codon). Interestingly, prfB and ssb show a peak after the AGR codon, where no peak is observed for dnaT Based on predictions from the Salis calculator, replacing AGR with CGU in those 3 cases is believed to disrupt ribosomal pausing (prfB and ssb) or to introduce ribosomal pausing (dnaT).

Consistent with this hypothesis, successful codon replacements from the troubleshooting pipeline conserve predicted RBS strength compared to the large predicted deviation caused by unsuccessful AGR→CGU mutations (FIG. 22, y axis and comparison between orange asterisks and green dots). Interestingly, attempts to replace dnaT_AGA10 with either CGN or NNN failed—only by manipulating the wobble position of surrounding codons and conserving the arginine amino acid could dnaT_AGA10 be replaced (FIG. 27C). These wobble variants appear to compensate for the increased RBS strength caused by the AGA→CGU mutation—RBS motif strength with wobble variants deviated 8-fold from the unmodified sequence, whereas RBS motif strength for AGA→CGU alone deviated 27-fold.

Figure 21D:
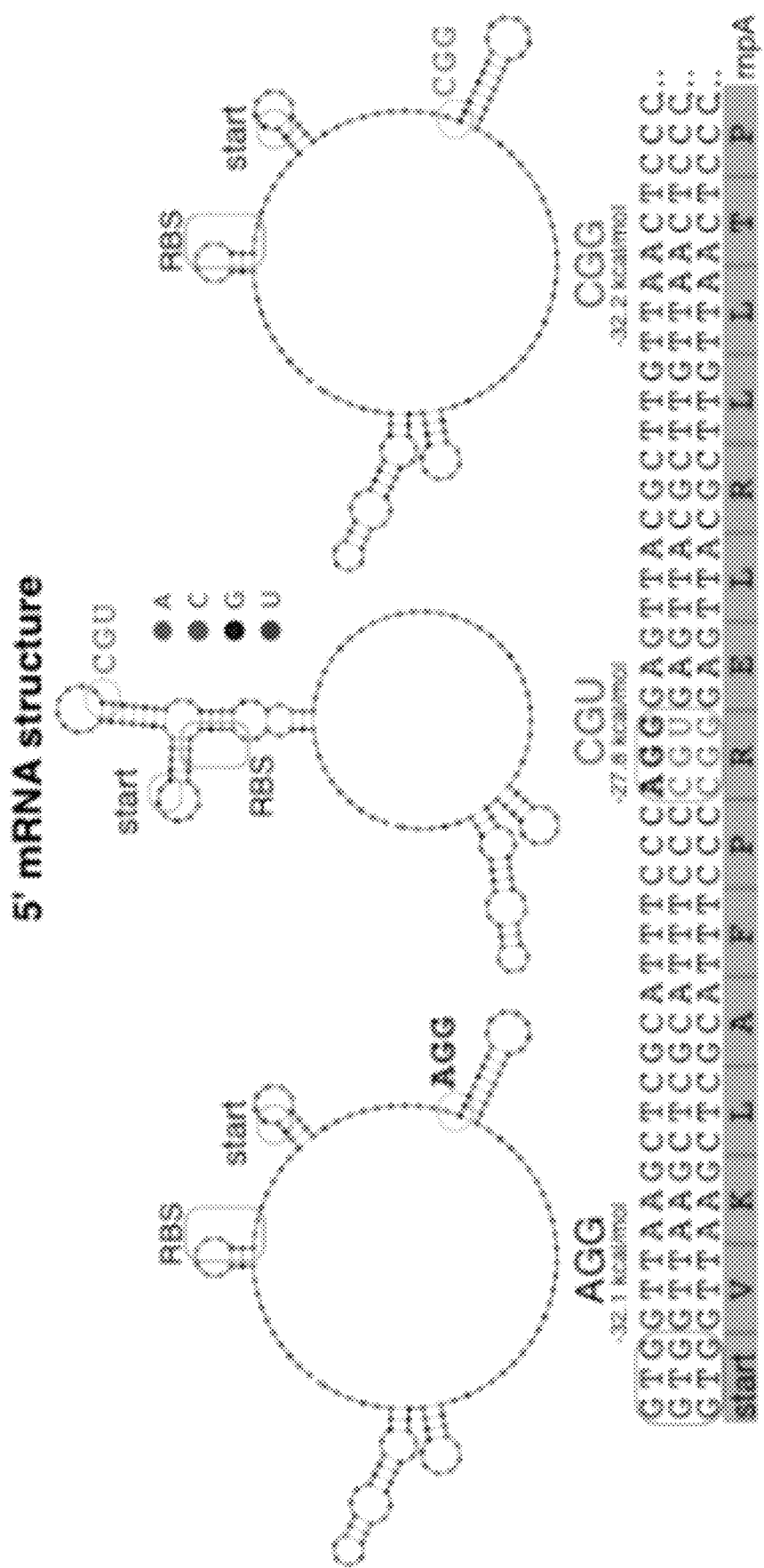
Figure 29:
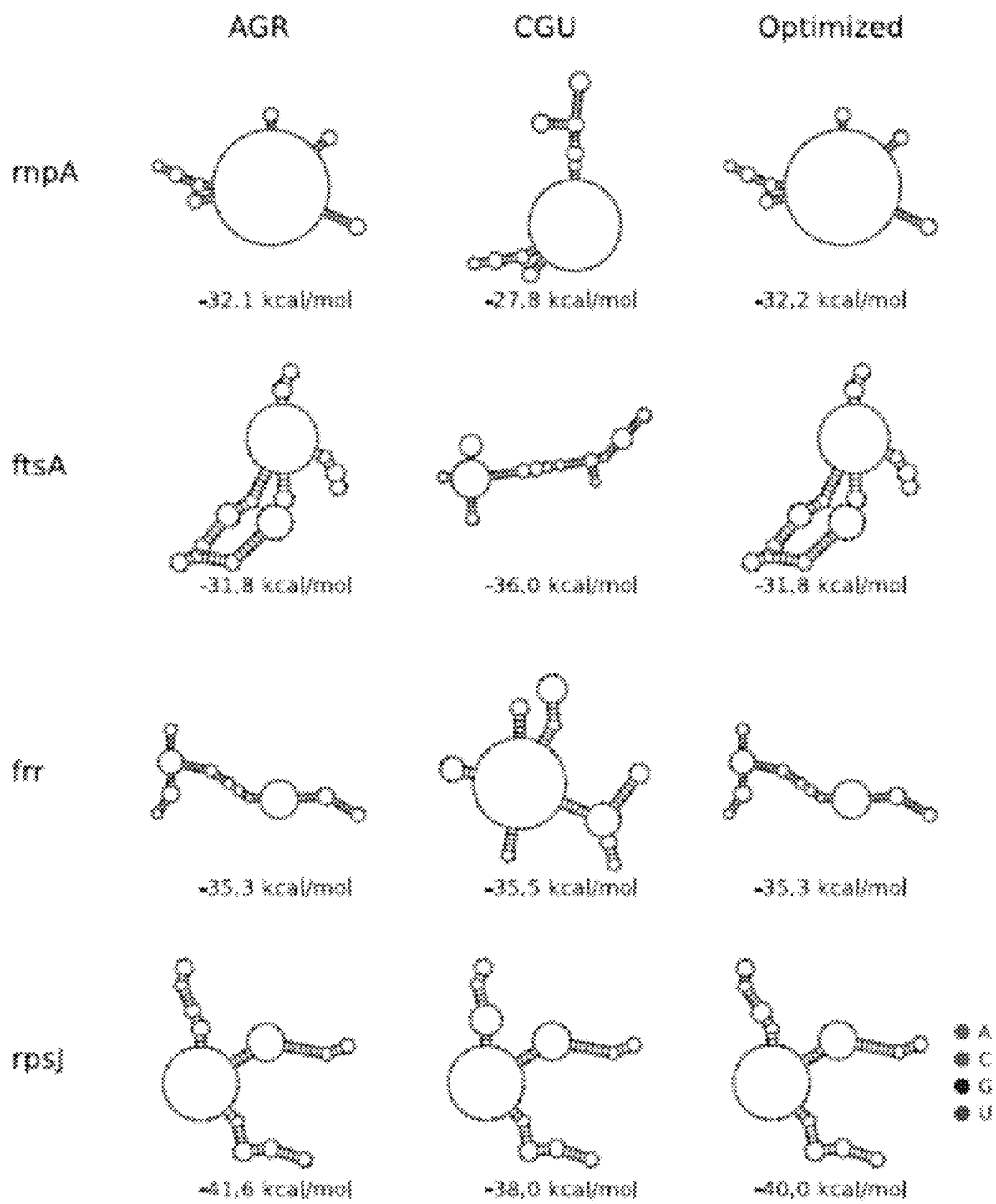
FIG. 29 illustrates an example of mRNA folding predictions for the 4 recalcitrant AGR→CGU mutations explained by mRNA folding variations. mRNA folding prediction of 100 nucleotides upstream and 30 nt downstream of the start codon using UNAfold (Markham et al., 2008). Both the shape of the mRNA folding and the folding energy value have to be taken into account to understand failure of the AGR→CGU conversion. 'AGR' depicts the predicted, wild-type mRNA, 'CGU' is the mRNA folding prediction with an AGR→CGU mutation (generally not observed) and 'Optimized' correspond to the mRNA folding prediction of the AGR replacement solution found after in vivo troubleshooting. Under each structure, the predicted free energy of folding of the visualized structure is listed in kcal/mol.
Figure 30A:
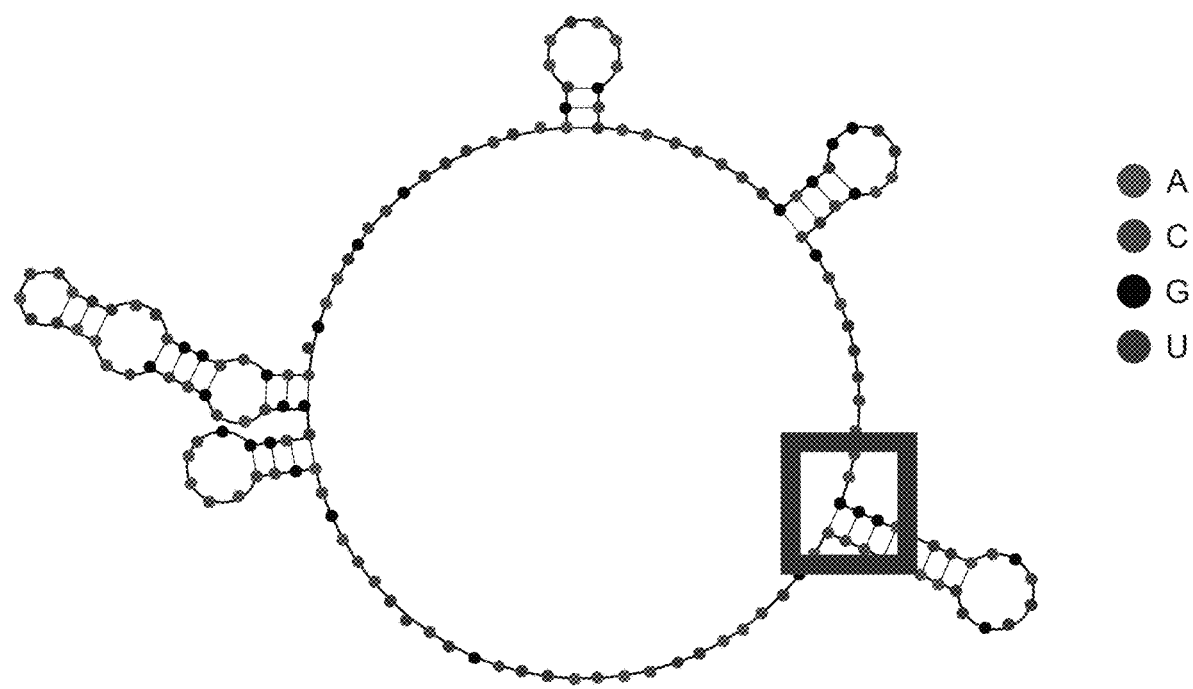
FIGS. 30A-30D illustrate an example of mRNA folding predictions for the gene rnpA. For folding predictions, 30 nucleotides were used upstream and 100 nucleotides downstream of the rnpA start site using UNAfold (Markham et al., 2008).
Figure 30B:
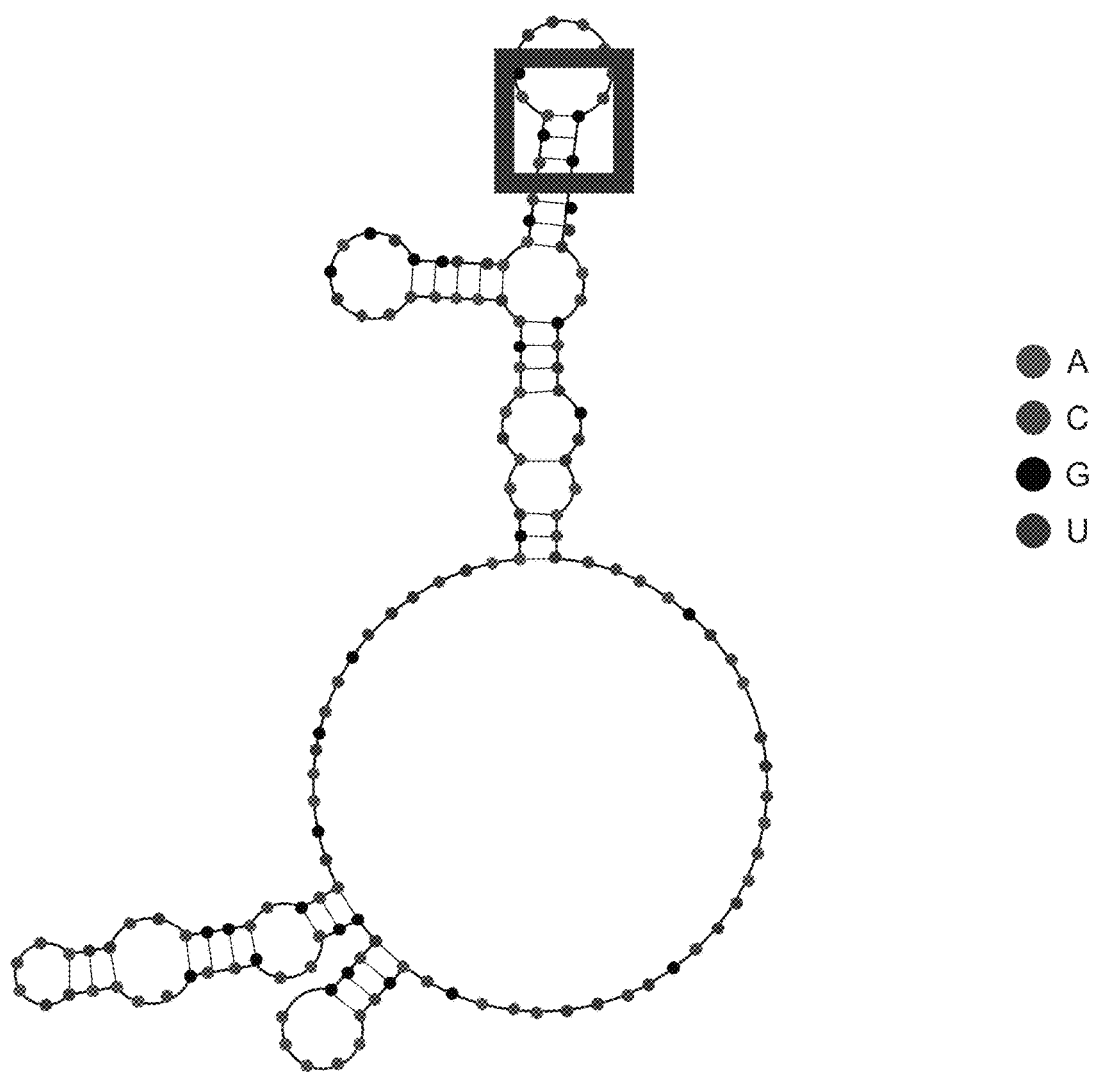
Figure 30C:
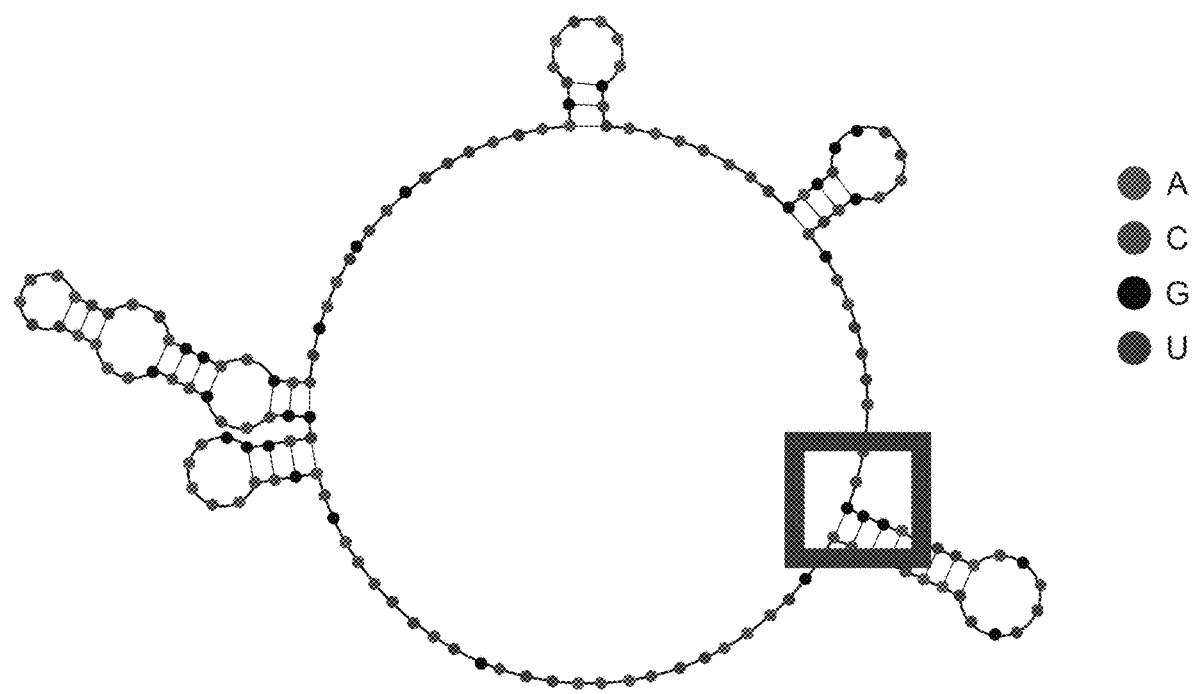
Figure 30D:
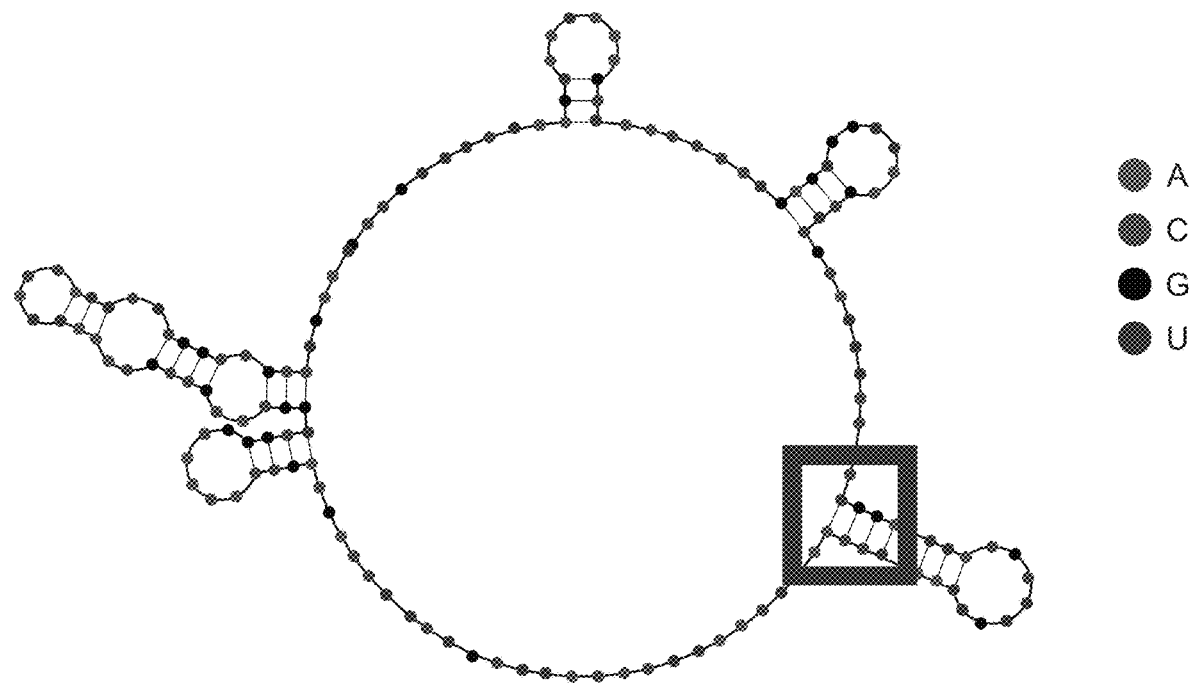

In order to better understand several remaining N-terminal failure cases that did not exhibit considerable RBS strength deviations (rnpA_AGG22, ftsA_AGA19, frr_AGA16, and rpsJ_AGA298), other potential nucleic acid determinants of protein expression were examined. Based on the observation that mRNA secondary structure near the 5' end of Open Reading Frames (ORFs) strongly impacts protein expression (Goodman et al., 2013), it was found that AGR→CGU mutations often changed the predicted folding energy and structure of the mRNA near the start codon of target genes (FIG. 21D and FIG. 29). Successful codon replacements obtained from degenerate MAGE oligos reduced the disruption of mRNA secondary structure compared to CGU (FIG. 22, green dots). For example, rnpA has a predicted mRNA loop near its RBS and start codon that relies on base pairing between both guanines of the AGG codon to nearby cytosines (FIG. 21D, FIG. 30A). Importantly, only AGG22CGG was observed out of all attempted rnpA AGG22CGN mutations, and the fact that only CGG preserves this mRNA structure suggests that it is physiologically important (FIG. 21D, FIG. 30B-30C). In support of this, a rnpA AGG22CUG mutation (Arg→Leu) was successfully introduced only when the complementary nucleotides in the stem were changed from CC (base pairs with AGG) to CA (base pairs with CUG), thus preserving the natural RNA structure (FIG. 30D) while changing both RBS motif strength and amino-acid identity.

The analysis of all four optimized gene sequences showed reduced deviation in computational mRNA folding energy (computed with UNAFold (Markham et al., 2008)) compared to the unsuccessful CGU mutations (FIG. 22, x-axis orange asterisks and green dots). Similarly, predicted mRNA structure (computed with a different mRNA folding software: NUPACK (Zadeh et al., 2011)) for these genes was strongly changed by CGU mutations and corrected in the empirically optimized solutions (FIG. 29).

Troubleshooting these 13 recalcitrant codons revealed that mutations causing large deviations from natural mRNA folding energy or RBS strength are associated with failed codon substitutions. By calculating these two metrics for all attempted AG→CGU mutations, a safe replacement zone (SRZ) was empirically defined inside which most CGU mutations were tolerated (FIG. 22, shaded area). The SRZ is defined as the largest multi-dimensional space which contains none of the mRNA folding energy or RBS strength associated recalcitrant AGR→CGU mutations (FIG. 22, red asterisks). It comprises deviations in mRNA folding energy of less than 10% with respect to the natural codon and deviations in RBS-like motif scores of less than a half log with respect to the natural codon, providing a quantitative guideline for codon substitution. Notably, the optimized solution used to replace the 13 recalcitrant codons always exhibited reduced deviation for at least one of these two parameters than the deviation seen with mutation to CGU. Furthermore, solutions to the 13 recalcitrant codons overlapped almost entirely with the empirically-defined SRZ. These results suggest that computational predictions of mRNA folding energy and RBS strength can be used as a first approximation to predict whether a designed mutation is likely to be lethal. By developing in silico heuristics to predict problematic alleles in turn reduces the search space required for in vivo genome engineering, making it possible to create radically altered genomes that remain viable.

Once viable replacement sequences were identified for all 13 recalcitrant codons, the successful 110 CGU conversions were combined with the 13 optimized codon substitutions to produce strain C123, which has all 123 AGR codons removed from all of its annotated essential genes. C123 was then sequenced to confirm AGR removal and analyzed using Millstone, a publicly available genome resequencing analysis pipeline (Goodman et al., 2015). Two spontaneous AAG (Lys) to AGG (Arg) mutations were observed in the essential genes pssA and cca. While attempts to revert these mutations to AAG were unsuccessful—perhaps suggesting functional compensation—they were replaced with CCG (Pro) in pssA and CAG (Gln) in cca using degenerate MAGE oligos. The resulting strain, C123a, is the first strain completely devoid of AGR codons in its annotated essential gene. This strain provides strong evidence that AGR codons can be completely removed from the *E. coli* genome, permitting the unambiguous reassignment of AGR translation function.

Figure 20B:
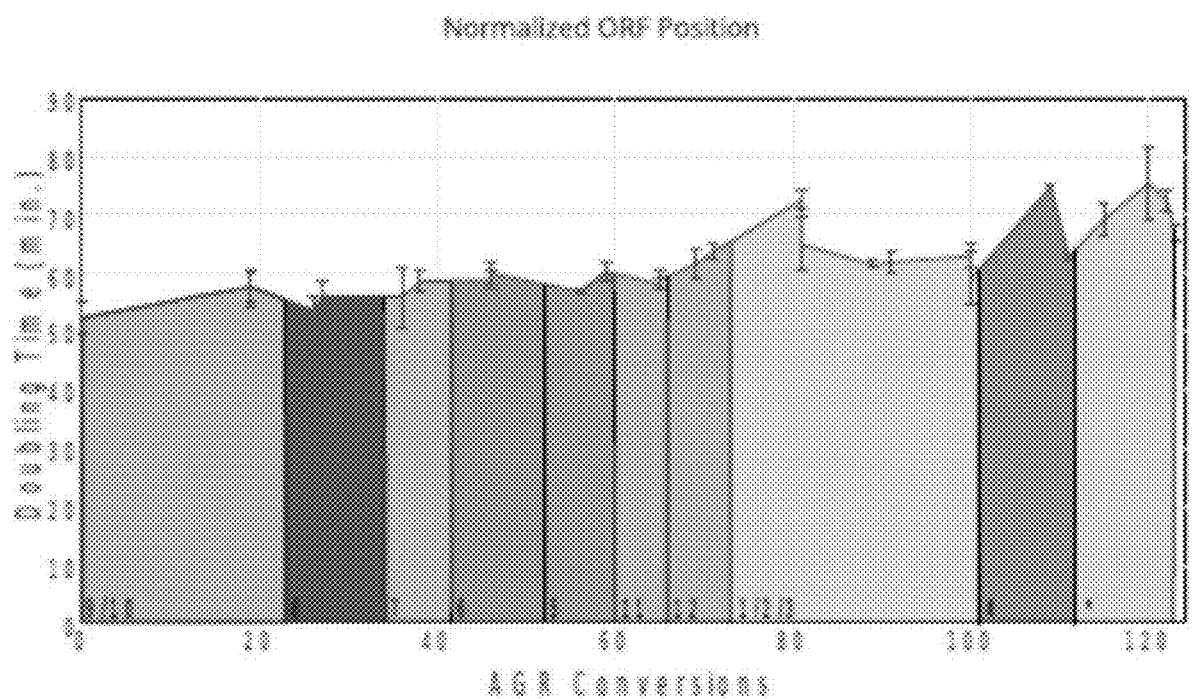
FIG. 20B illustrates doubling time of strains in the C123 lineage in LBL media at 34° C. was determined in triplicate on a 96-well plate reader. Colored bars indicate which set of codons was under construction when a doubling time was determined. Recalcitrant AGR→CGU conversions that were unsuccessful (i.e., MASC-PCR frequency <1/96) were triaged into a troubleshooting pipeline. The optimized replacement sequences for these 13 recalcitrant AGR codons were incorporated into the final strain (gray section at right, labeled with a '*'), and the resulting doubling times were measured.
Figure 31:
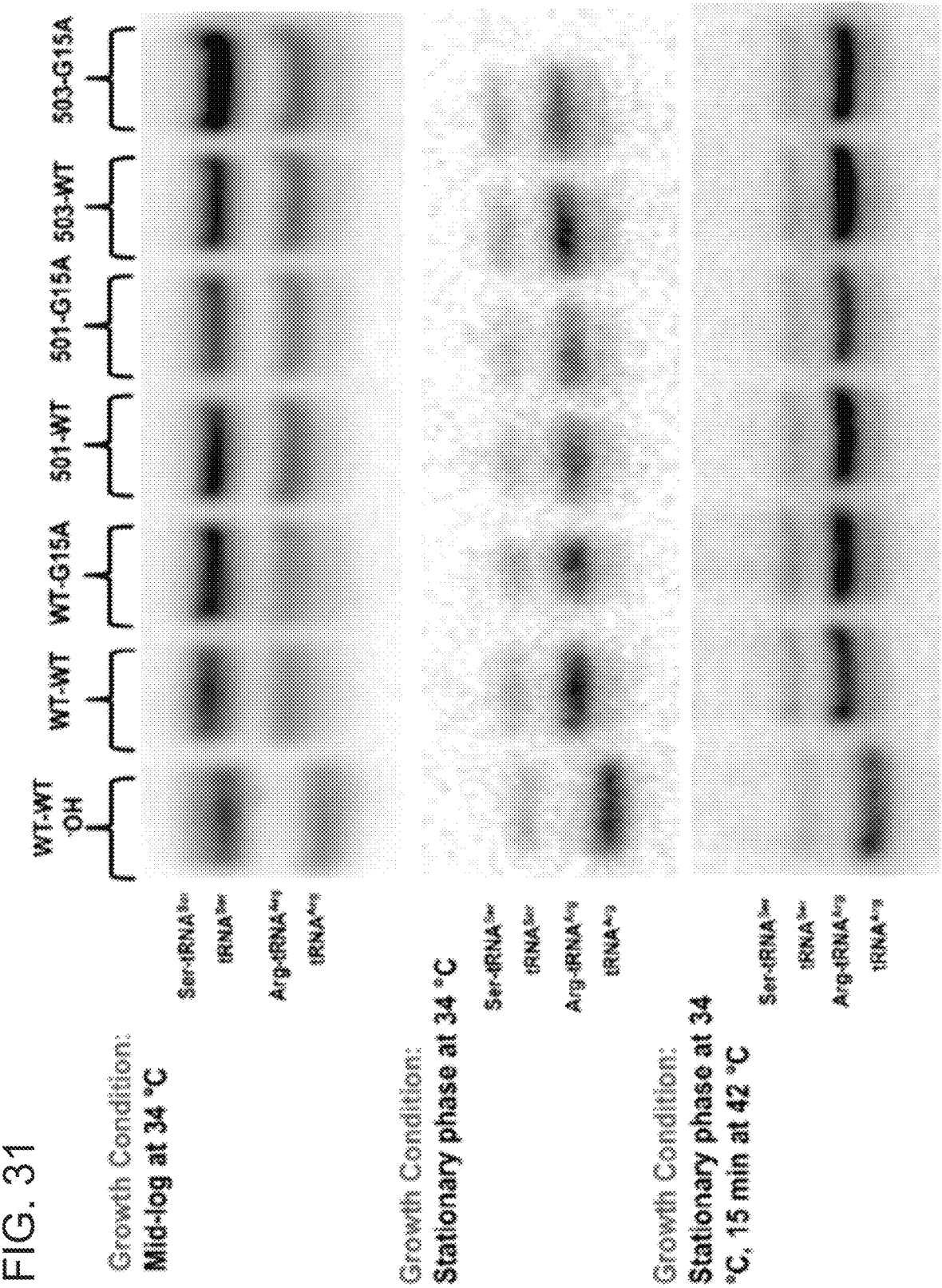
FIG. 31 illustrates an example in which G15A ArgU does not affect expression and aminoacylation levels in WT and recoded E. coli strains. Northern blot Acid-Urea PAGE was performed on WT and G15A argU tRNA in wild-type E. coli (WT-WT and WT-G15A), and in the final strains C123a and b (501 and 503) at several growth conditions. Aminoacylation levels are comparable to wild-type for all conditions and combinations, suggesting no effect on charging levels despite the mutation sweeping into the population.
Figure 35:
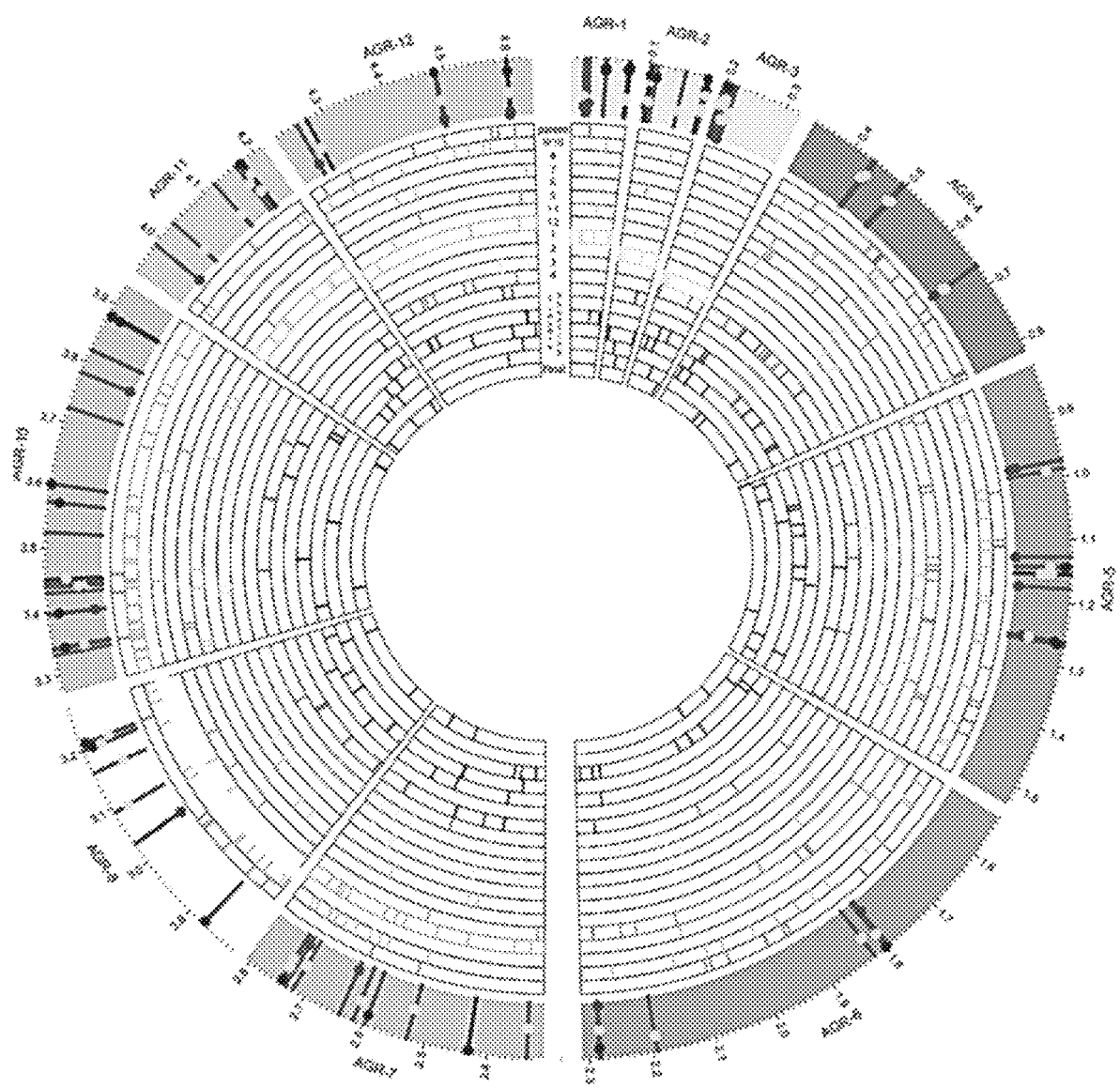
FIG. 35 illustrates an example of a representational graph of the fully recoded genome relative to MG1655. The outer ring contains the set grouping that each AGR codon (vertical line) is in. Each line contains information on troubleshooting (red if troubleshot, green if not), and relative recombination frequency (dot). Each internal ring represents the mutations accumulated during that sets creation, the active set for each ring is highlighted. The internal rings represent the troubleshooting steps during strain construction.

Kinetic growth analysis showed that the doubling time increased from 52.4 (+/−2.6) minutes in EcM2.1 (0 AGR codons changed) to 67 (+/−1.5) minutes in C123a (123 AGR codons changed in essential genes) in lysogeny broth (LB) at 34° C. in a 96-well plate reader. Notably, fitness varied significantly during C123 strain construction (FIG. 20B). This may be attributed to codon deoptimization (AGR→CGU) and compensatory spontaneous mutations to alleviate fitness defects in a mismatch repair deficient (mutS−) background. Overall the reduced fitness of C123a may be caused by on-target (AGR→CGU) or off-target (spontaneous mutations) that occurred during strain construction. In this way, mutS inactivation is simultaneously a useful evolutionary tool and a liability. Final genome sequence analysis revealed that along with the 123 desired AGR conversions, C123a had 419 spontaneous non-synonymous mutations not found in the EcM2.1 parental strain (FIG. 35). Of particular interest was the mutation argU_G15A, located in the D arm of tRNA$^{Arg}$ (argU), which arose during CoS-MAGE with AGR set 4. It was hypothesized that argU_G15A compensates for increased CGU demand and decreased AGR demand, but no direct fitness cost associated with reverting this mutation in C123 was observed, and argU_G15A does not impact aminoacylation efficiency in vitro or aminoacyl-tRNA pools in vivo (FIG. 31). Consistent with Mukai et al. and Baba et al. (Mukai et al., 2015, Baba, et al., 2006), argW (tRNA$^{Arg}$CCU; decodes AGG only) was dispensable in C123a because it can be complemented by argU (tRNA$^{Arg}$UCU; decodes both AGG and AGA). However, argU is the only *E. coli* tRNA that can decode AGA and remains essential in C123a probably because it is required to translate the AGR codons for the rest of the proteome (Lajoie et al., 2013b).

Figure 23:
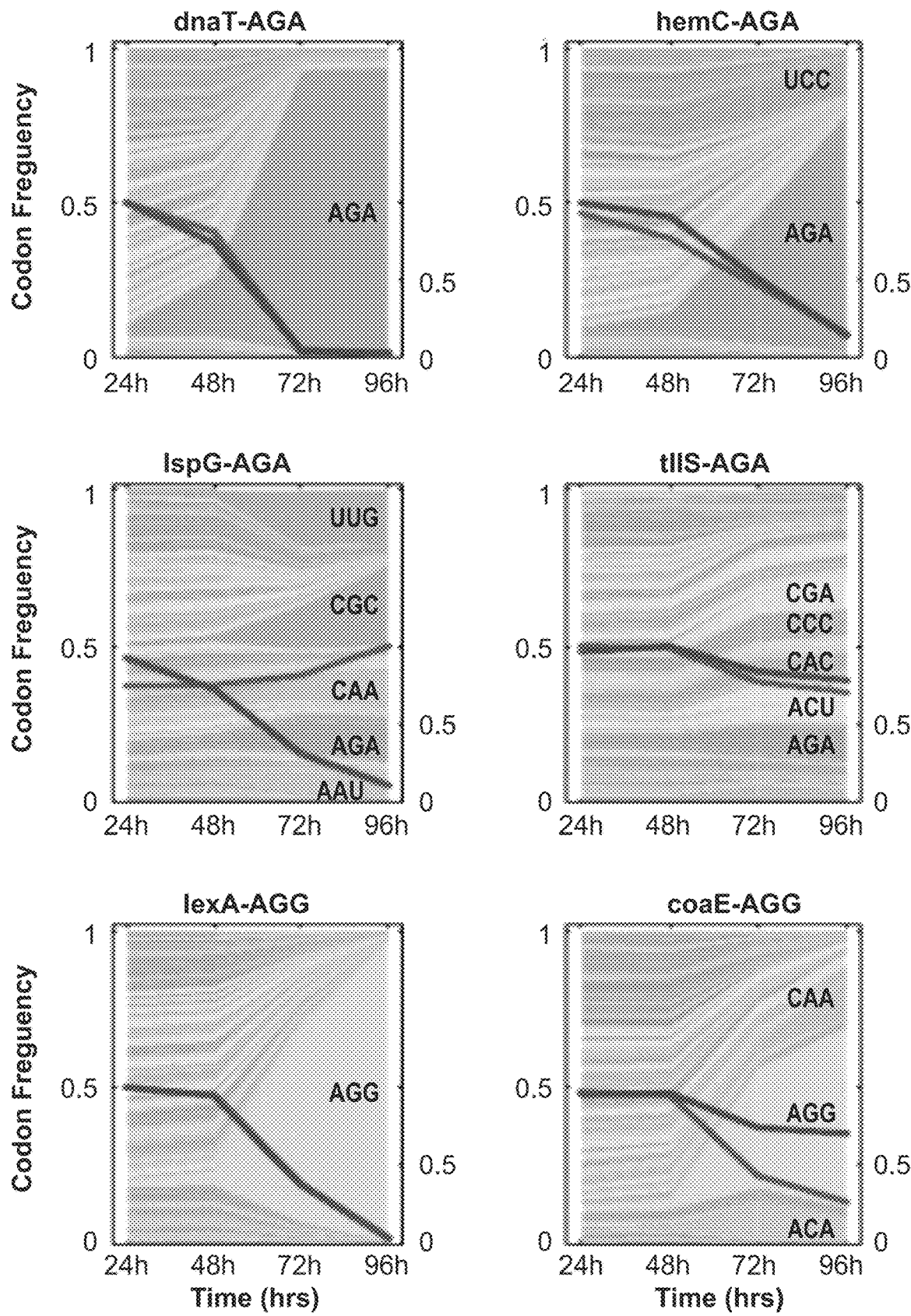
FIG. 23 illustrates an example of codon preference of 14 N-terminal AGR codons. CRAM (Crispr-Assisted MAGE) was used to explore codon preference for several AGR codons located within the first 10 codons of their CDS. Briefly, MAGE was used to diversify a population by randomizing the AGR of interest, then a CRISPR/Cas9 system as generally known in the art using guide RNA and a Cas enzyme was used to deplete the parental (unmodified) population, allowing exhaustive exploration of all 64 codons at a position of interest. Thereafter codon abundance was monitored over time by serially passaging the population of cells and sequencing using an Illumina MiSeq. The left y-axis (Codon Frequency) indicates relative abundance of a particular codon (stacked area plot). The right y-axis indicates the combined deviations in mRNA folding structure (red line) and internal RBS strength (blue line) in arbitrary units (AU) normalized to 0.5 at the initial timepoint. 0 means no deviation from wild type. The horizontal axis indicates the experimental time point in hours at which a particular reading of the population diversity was obtained. Genes bcsB and chpS are non-essential in examples of strains described herein and thus serve as controls for AGR codons that are not under essential gene pressure.
Figure 23:
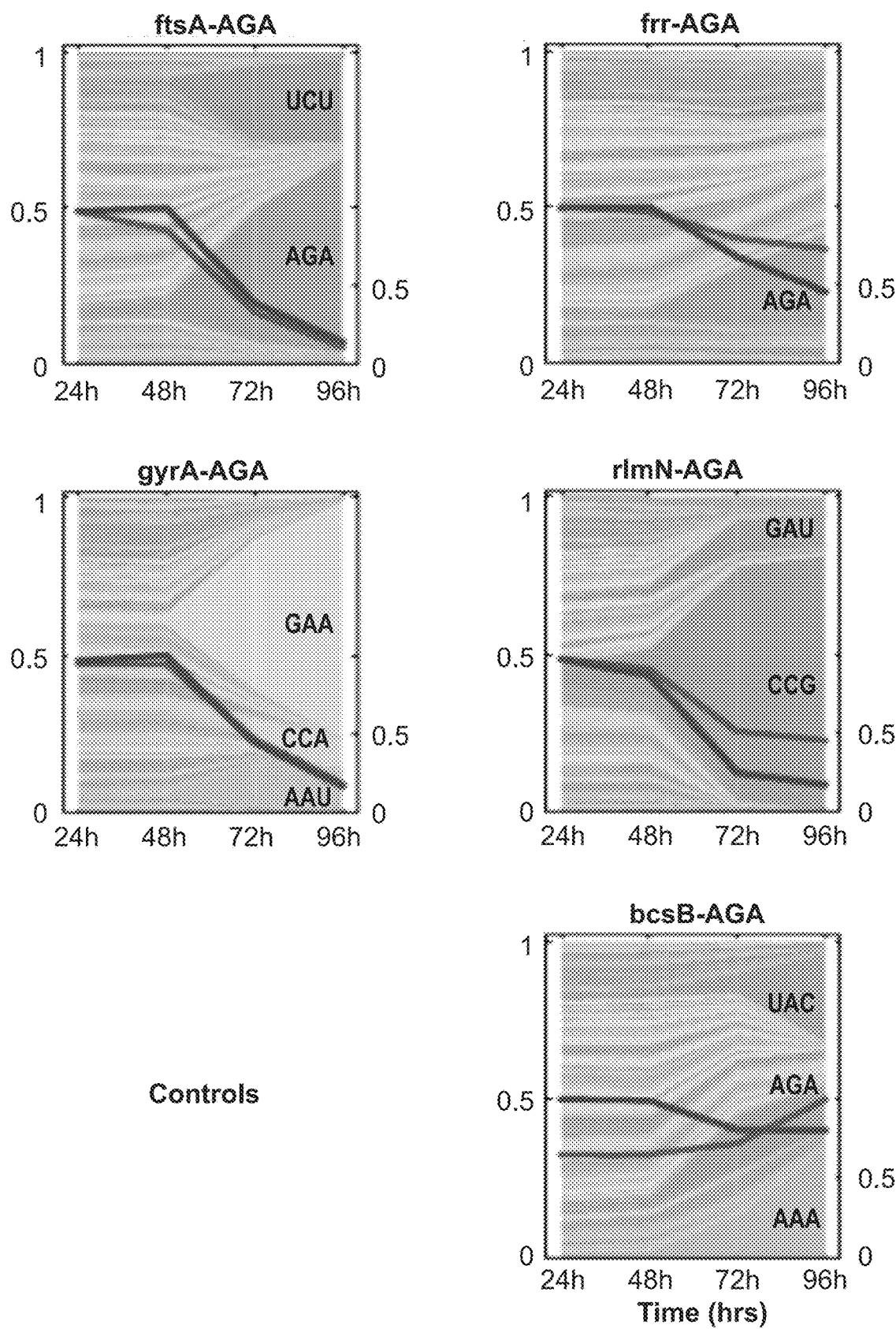
Figure 23:
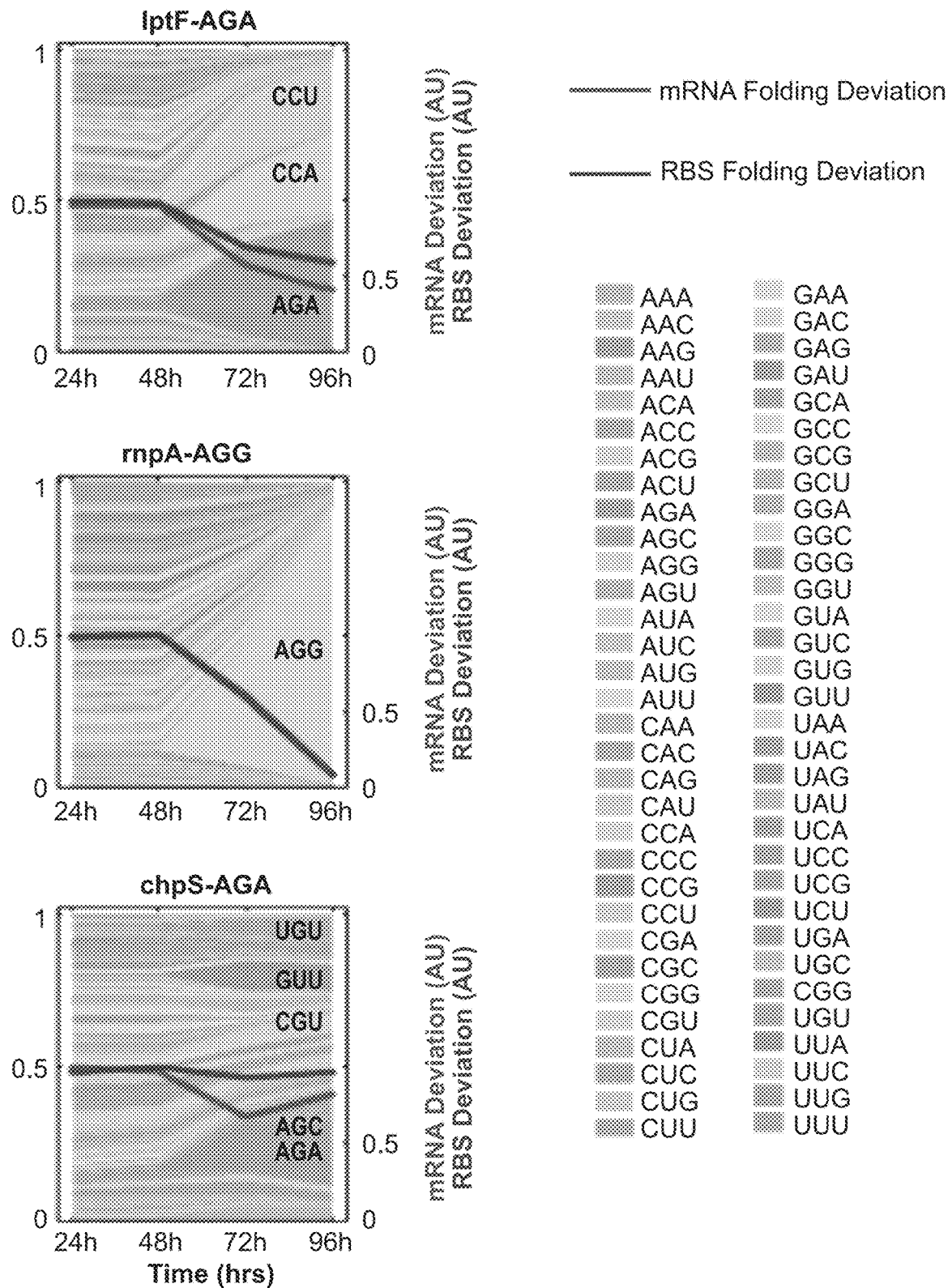

To evaluate the genetic stability of C123a after removal of all AGR codons from all the known essential genes, C123a was for passaged 78 days (640 generations) to test whether AGR codons would recur and/or whether spontaneous mutations would improve fitness. After 78 days, no additional AGR codons were detectable in a sequenced population, and doubling time of isolated clones ranged from 22% faster to 22% slower than C123a (n=60). To gain more insight into how local RBS strength and mRNA folding impact codon choice, an evolution experiment was performed to examine the competitive fitness of all 64 possible codon substitutions at each of AGR codons. While MAGE is a powerful method to explore viable genomic modifications in vivo, it was of interest to map the fitness cost associated with less-optimal codon choices, requiring codon randomization depleted of the parental genotype, which was hypothesized to be at or near the global fitness maximum. To do this, a method called CRAM (Crispr-Assisted-MAGE) was developed. First, oligos were designed that changed not only the target AGR codon to NNN, but also made several synonymous changes at least 50 nt downstream that would disrupt a 20 bp CRISPR target locus. MAGE was used to replace each AGR with NNN in parallel, and CRISPR/cas9 was used to deplete the population of cells with the parental genotype. This approach allowed exhaustive exploration of the codon space, including the original codon, but absent the preponderance of the parental genotype. Following CRAM, the population was passaged 1:100 every 24 hours for six days, and sampled prior to each passage using Illumina sequencing (FIG. 23).

Figure 32:
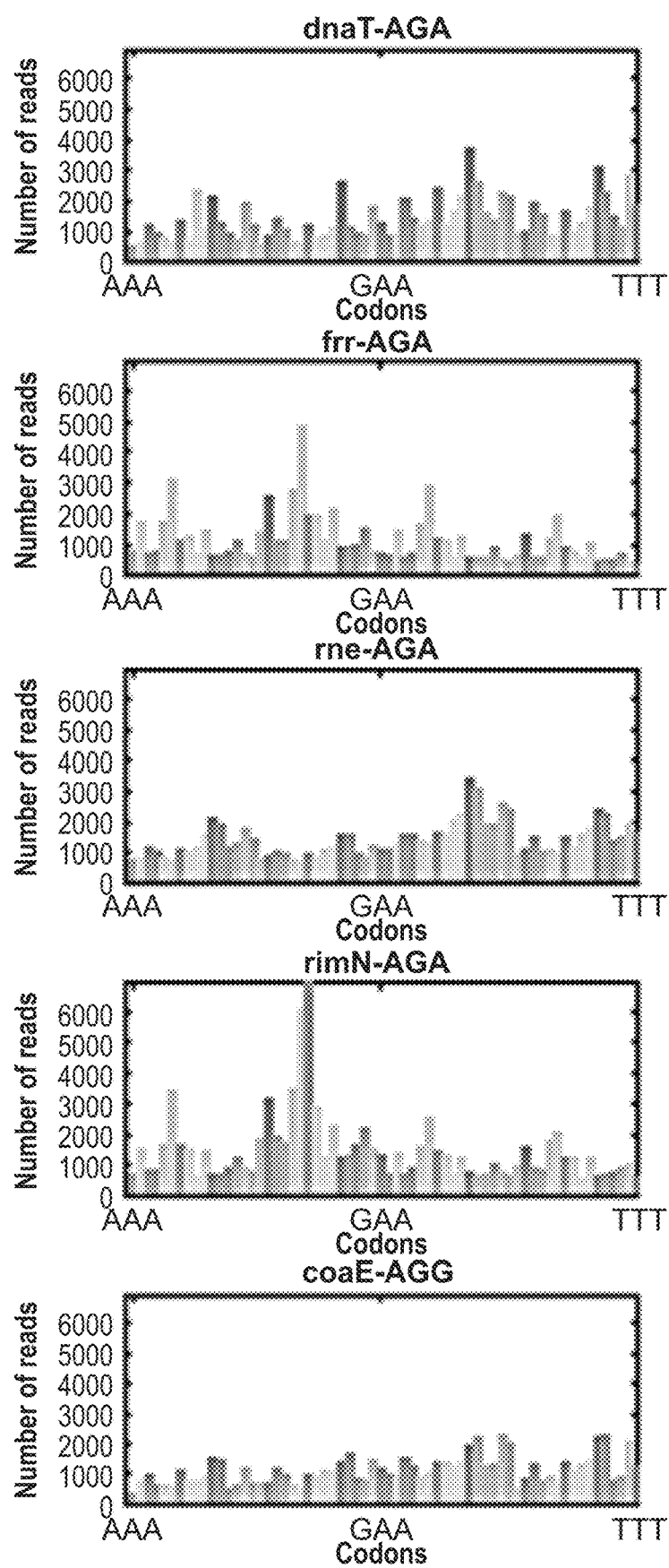
FIG. 32 illustrates an example of a number of reads for each codon and for each gene in the CRAM experiment at time point 24 hrs. CRAM (Crispr-Assisted MAGE) was used to explore codon preference for several N-terminal AGR codons. The left y-axis (Number of reads) indicates abundance of a particular codon. The x-axis indicates the 64 possible codons ranked from AAA to TTT in alphabetical order. Experimental time point 24 hrs is presented. Diversity was assayed by Illumina sequencing. Genes bcsB and chpS are non-essential and thus serve as controls for AGR codons that are not under essential gene pressure.
Figure 32:
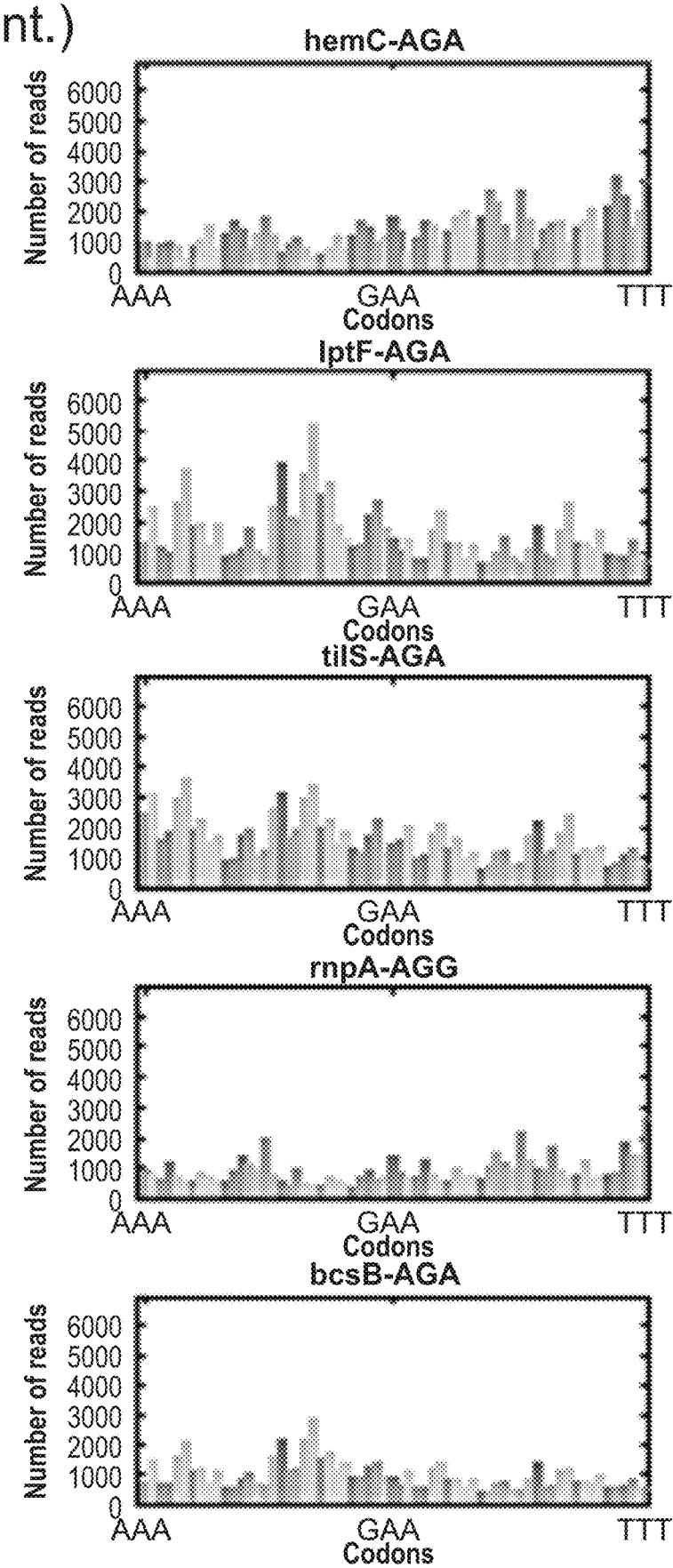
Figure 32:
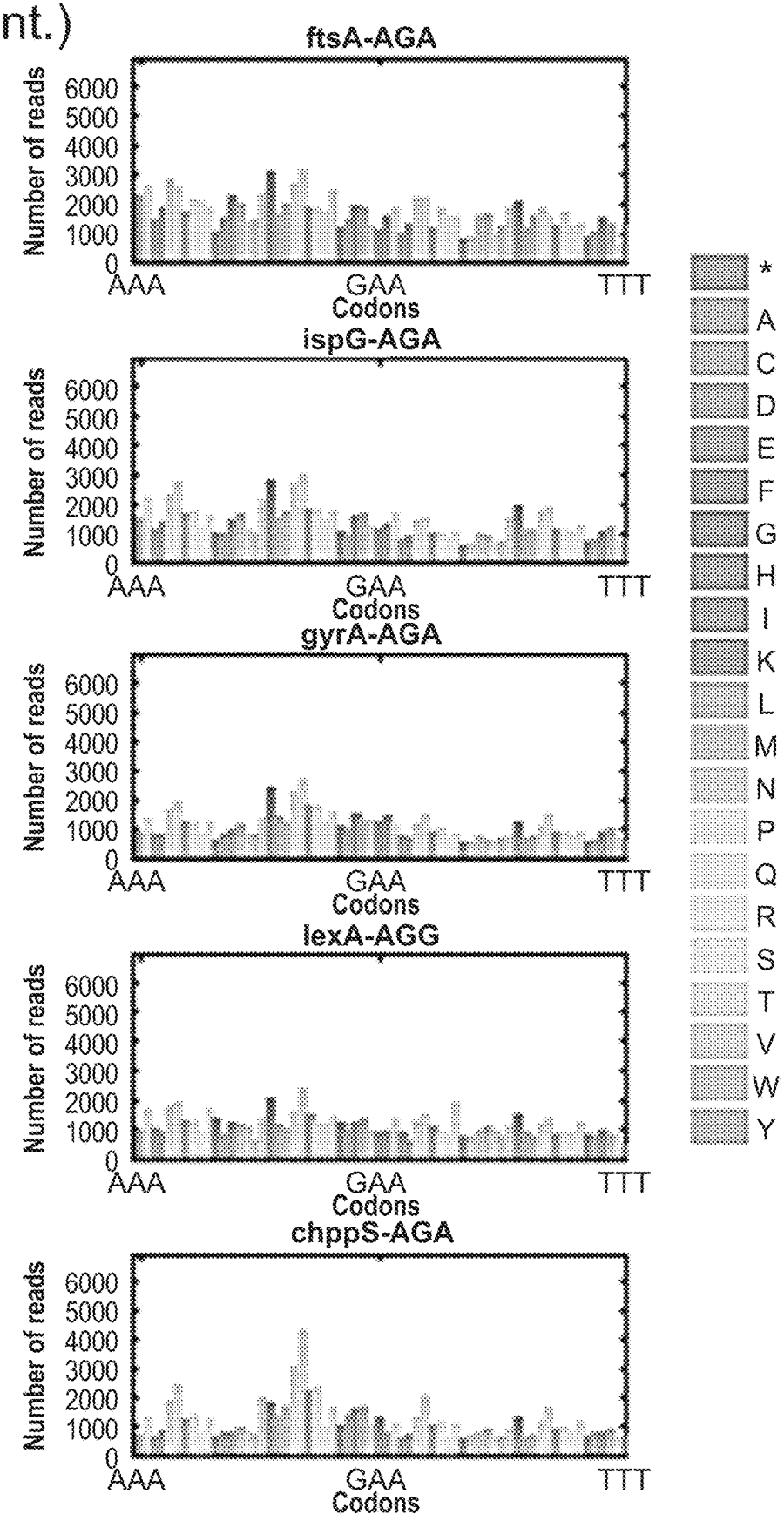
Figure 33:
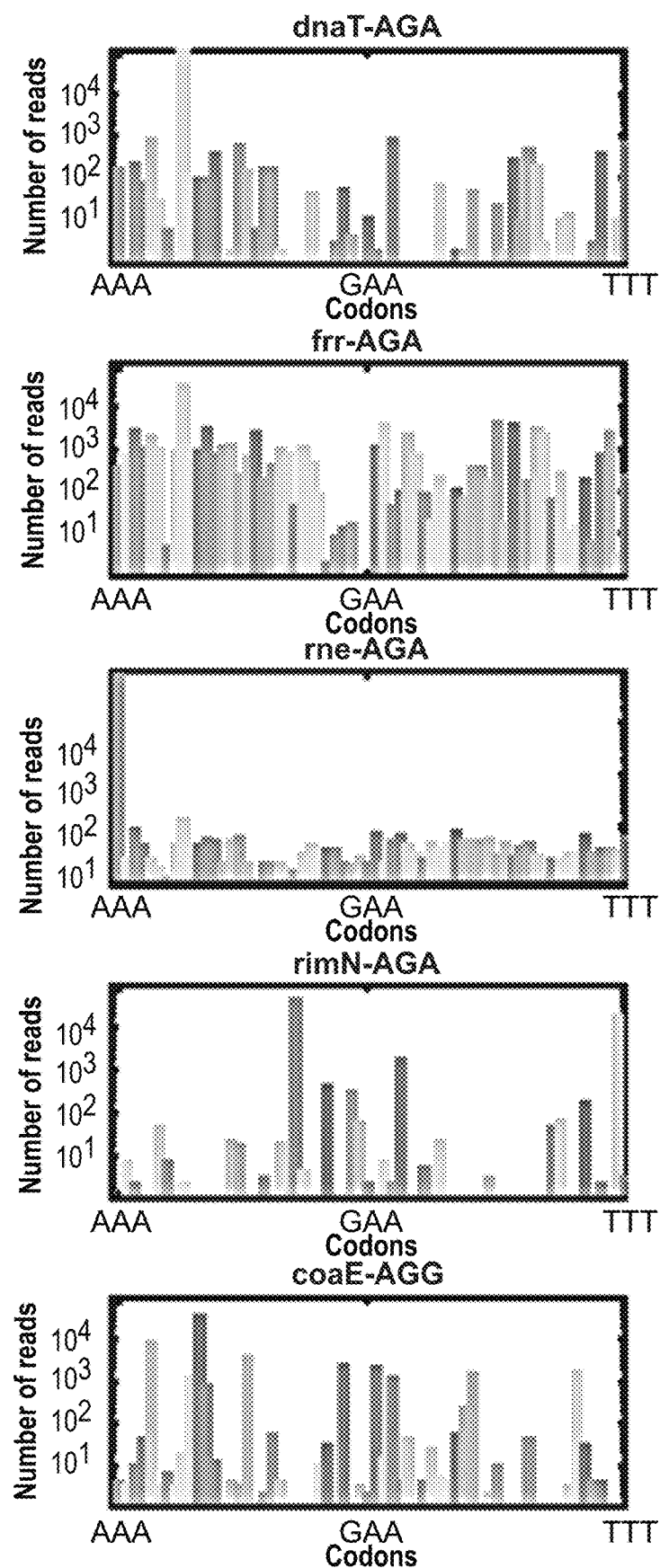
FIG. 33 illustrates an example of a number of reads for each codon and for each gene in the CRAM experiment at time point 144 hrs. CRAM (Crispr-Assisted MAGE) was used to explore codon preference for several N-terminal AGR codons. The left y-axis (Number of reads) indicates abundance of a particular codon. The x-axis indicates the 64 possible codons ranked from AAA to TTT in alphabetical order. Experimental time point 144 hrs is presented. Diversity was assayed by Illumina sequencing. Genes bcsB and chpS are non-essential and thus serve as controls for AGR codons that are not under essential gene pressure.
Figure 33:
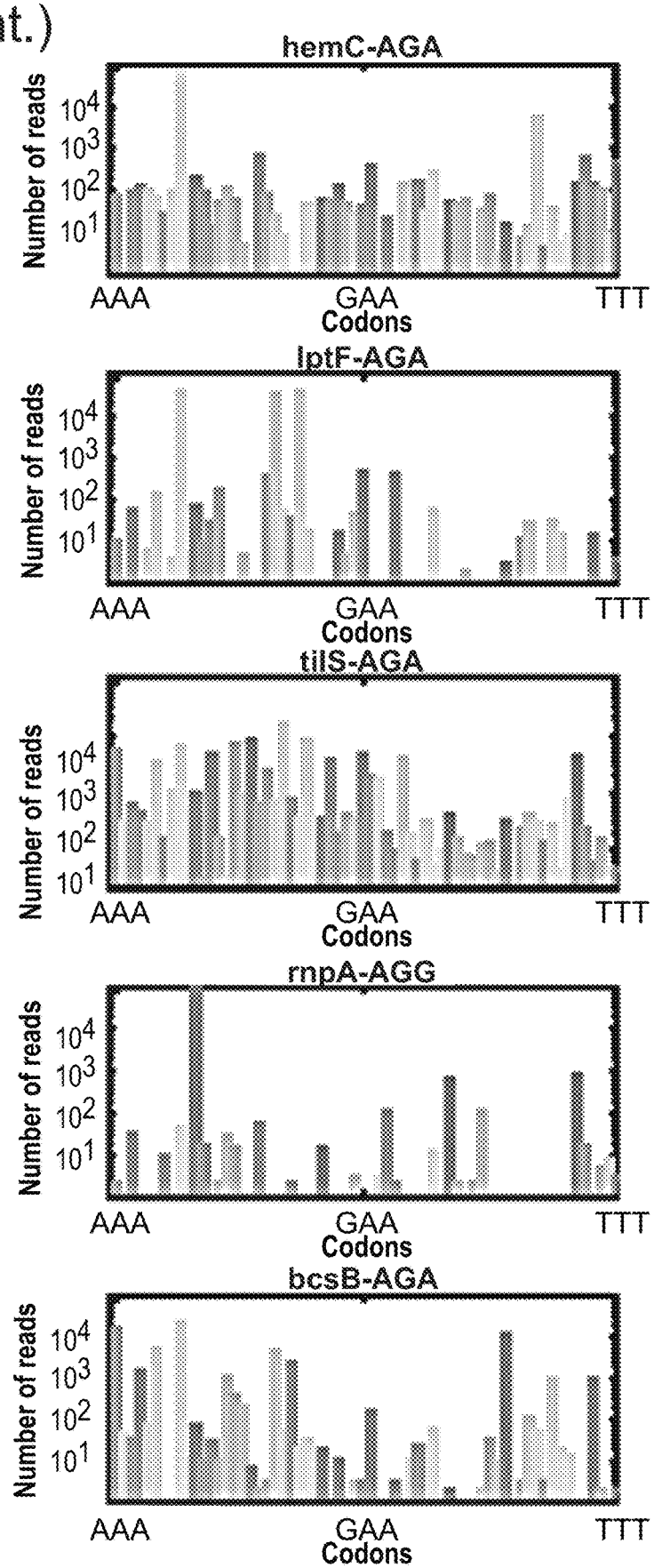
Figure 33:
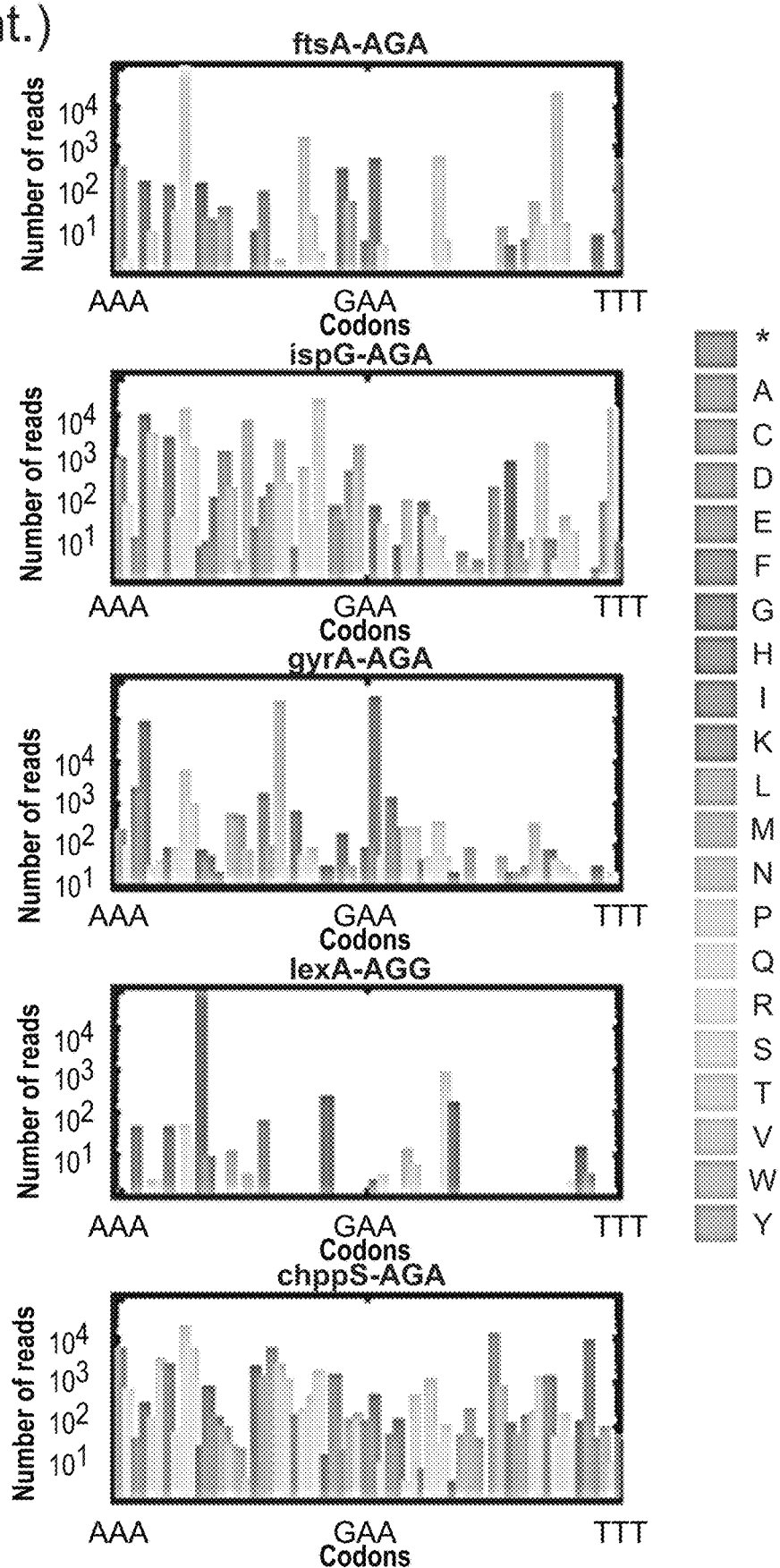

Sequencing 24 hours after CRAM showed that all codons were present (including stop codons) (FIG. 32), validating the method as a technique to generate massive diversity in a population. All sequences for further analysis were amplified by PCR with allele-specific primers containing the changed downstream sequence. Subsequent passaging of these populations revealed many gene-specific trends (FIG. 23, FIG. 33, FIG. 33). Notably, all codons that required troubleshooting (dnaT_AGA10, ftsA_AGA19, frr_AGA16, rnpA_AGG22) converged to their wild-type AGR codon, suggesting that the original codon was globally optimized. For all cases where an alternate codon replaced the original AGR, the predicted deviation in mRNA folding energy and local RBS strength (as a proxy for ribosome pausing) was computed for these alternative codons and compared these metrics to the evolution of codon distribution at this position over time. The fraction of sequences that fall within the SRZ inferred was also computed from FIG. 22. CRAM initially introduced a large diversity of mRNA folding energies and RBS strengths, but these genotypes rapidly converged toward parameters that are similar to the parental AGR values in many cases (FIG. 23, overlays). Codons that strongly disrupted predicted mRNA folding and internal RBS strength near the start of genes were disfavored after several days of growth, suggesting that these metrics can be used to predict optimal codon substitutions in silico. In contrast, non-essential control genes bcsB and chpS did not converge toward codons that conserved RNA structure or RBS strength, supporting the conclusion that the observed conservation in RNA secondary structure and RBS strength is biologically relevant for essential genes. Interestingly, tilS_AGA19 was less sensitive to this effect, suggesting that codon choice at that particular position is not under selection. Additionally, the average internal RBS strength for the ipsG populations converged towards the parental AGR values whereas mRNA folding energy averages did not, suggesting that this position in the gene may be more sensitive to RBS disruption rather than mRNA folding. Gene lptF followed the opposite trend.

Figure 24:
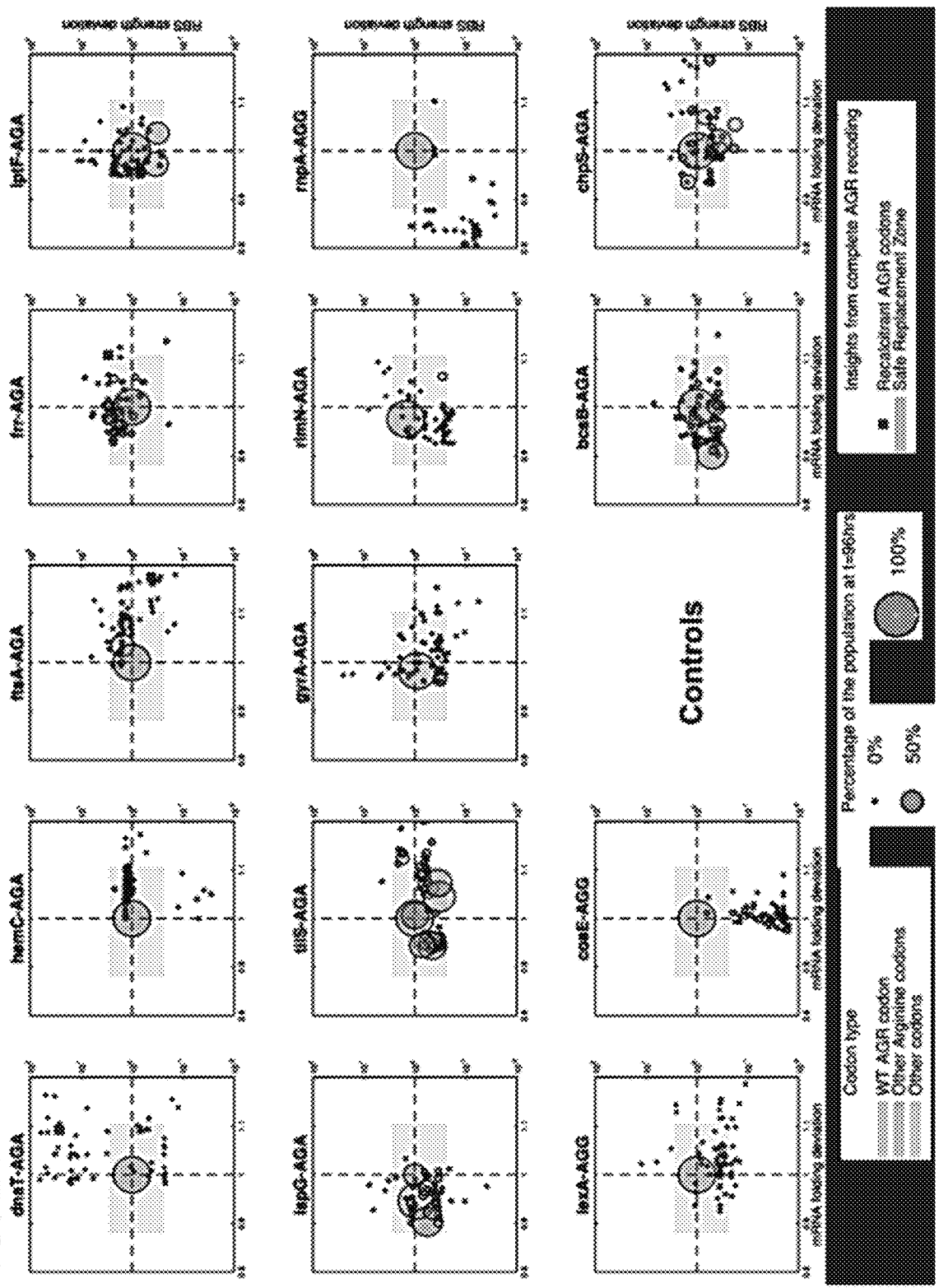
FIG. 24 illustrates an example in which RBS strength and mRNA structure predict codon preference of 14 N-terminal codon substitutions. In particular.
Figure 26:
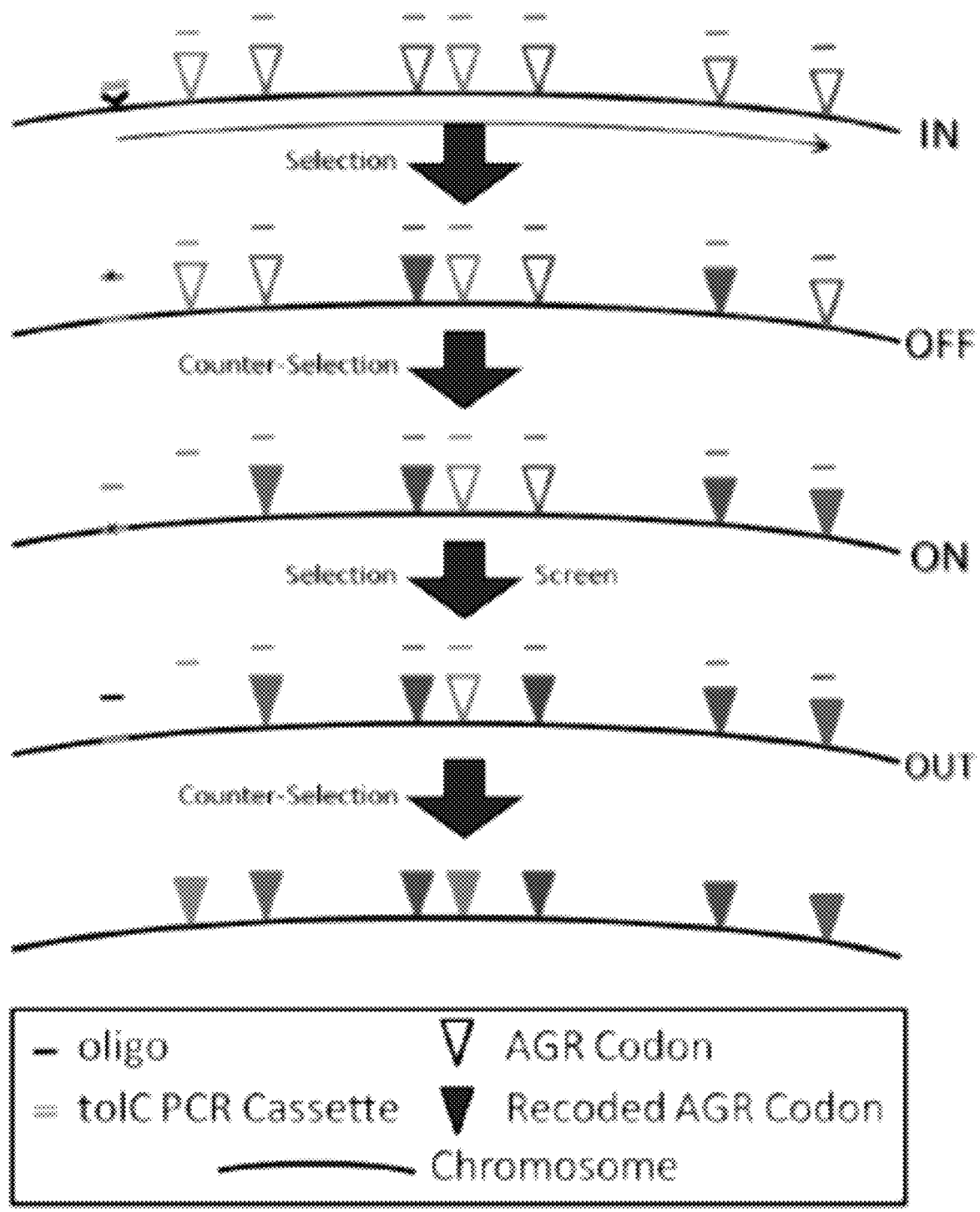
FIG. 26 illustrates an example strategy for replacing each "set" of AGR codons in all of the essential genes of *Escherichia coli* (EcM2.1). Here the AGR codons are marked with open triangles (various colors). To start, a dual-selectable tolC cassette (double green line) is recombined into the genome using lambda red in a multiplexed recombination along with several oligos targeting nearby (<500 kb), downstream AGR loci (various colored lines). Upon selection for tolC insertion clones, correctly chosen AGR codons are also observed (filled in triangles) at a higher frequency due to strong linkage between recombination events at tolC and other nearby (<500 kb), downstream AGR loci. Next, a second recombination is carried out using the same AGR conversion oligo pool, but now paired with another oligo to disrupt the tolC ORF with a premature stop, after which the tolC counter-selection is applied, again enriching the population for AGR conversions. A third, multiplexed recombination then fixes the tolC ORF, again targeting AGR loci. After applying the tolC selection clones are assayed by MASC-PCR. Assuming most conversions in a given set had been made, the selectable marker would then be removed using a repair oligo in a singleplexed or multiplexed recombination (depending on need). The tolC counter-selection is then leveraged to both leave a scarless chromosome and free up the tolC cassette for use elsewhere in the genome.

Interestingly, several genes (lptF, ipsG, tilS, gyrA and rimN) preferred codons that changed the amino acid identity from Arg to Pro, Lys, or Glu, suggesting that non-coding functions trump amino acid identity at these positions. Importantly, all successful codon substitutions in essential genes fell within the SRZ (FIG. 24), validating the heuristics based on an unbiased test of all 64 codons. Meanwhile non-essential control gene chpS exhibited less dependence on the SRZ. Based on these observations, while global codon bias may be affected by tRNA availability (Plotkin et al., 2011, Novoa et al., 2012, Ikemura, 1985), codon choice at a given position may be defined by at least 3 parameters: (1) amino acid sequence, (2) mRNA structure near the start codon and RBS (3) RBS-mediated pausing. In some cases, a subset of these parameters may not be under selection, resulting in an evolved sequence that only converges for a subset of the metrics. In other cases, all metrics may be important, but the primary nucleic acid sequence might not have the flexibility to accommodate all of them equally, resulting in codon substitutions that impair cellular fitness.

Figure 34:
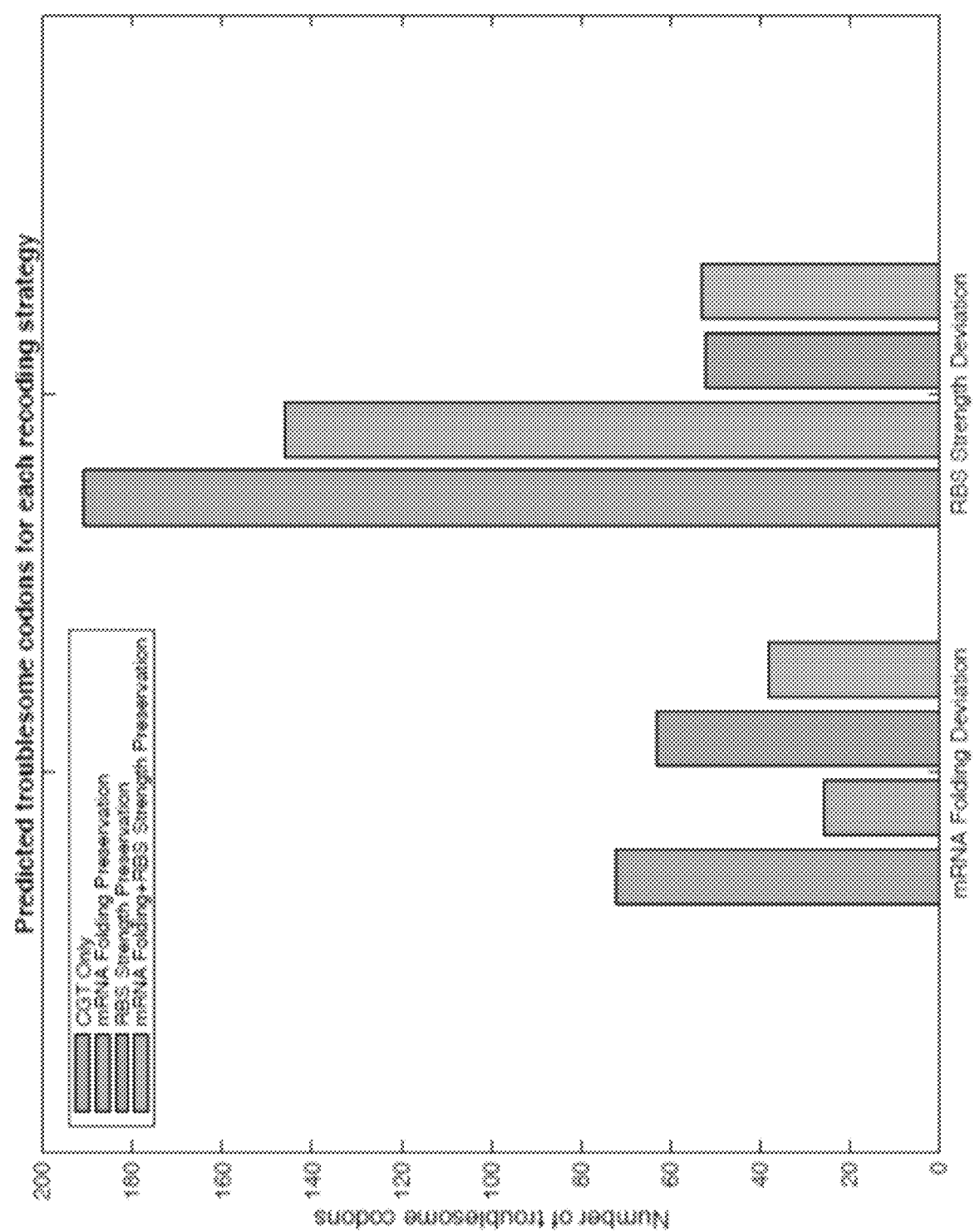
FIG. 34 illustrates an example of a number of predicted recalcitrant AGR codons for each AGR replacement strategy. 4 possible genomes replacing all 3222 AGRs have been designed using 4 replacement strategies. First AGRs were changed to CGU genome-wide (green bars). Second, AGR synonyms were chosen to minimize local mRNA folding deviation near the start of genes (orange bars). Third, AGR synonyms were chosen to reduce RBS strength deviation (blue bars). Finally, AGR synonyms were chosen to minimize both (purple bars). These genomes were then scored using custom software and compared. Every deviation outside of the Safe Replacement Zone is predicted to be a recalcitrant codon.

These rules were used to generate a draft genome in silico with all AGR codons replaced genome-wide, reducing by almost fourfold the number of predicted design flaws (e.g., synonymous codons with metrics outside of the SRZ) compared to the naïve replacement strategy (FIG. 25A-25B, FIG. 34). Furthermore, predicting recalcitrant codons provides hypotheses that can be rapidly tested in vivo using MAGE. Successful replacement sequences can then be implemented together in a redesigned genome. These rules are expected to increase the tractability of creating a genome completely devoid of AGR codons, which could be used for unambiguously reassigning AGR translation function.

Comprehensively removing all instances of AGR codons from E. coli essential genes revealed 13 design flaws which could be explained by a disruption in coding DNA Sequence, RBS-mediated translation initiation/pausing, or mRNA structure. While the importance of each factor has been reported, methods described herein systematically explore to what extent and at what frequency they impact genome function. Furthermore, methods described herein establish quantitative guidelines to reduce the chance of designing non-viable genomes. Although additional factors undoubtedly impact genome function, the fact that these guidelines captured all instances of failed synonymous codon replacements (FIG. 22) suggests that the disclosed genome design guidelines provide a strong first approximation of acceptable modifications to the primary sequence of viable genomes. These design rules coupled with inexpensive DNA synthesis will facilitate the construction of radically redesigned genomes exhibiting useful properties such as biocontainment, virus resistance, and expanded amino acid repertoires (Lajoie et al., 2015).

Materials and Methods

Strains and Culture Methods Used

The strains used in this work were derived from EcM2.1 (Escherichia coli MG1655 mutS_mut dnaG_Q576AexoX_mut xonA_mut xseA_mut 1255700::tolQRA Δ(ybhB-bioAB)::[λcI857 N(cro-ea59)::tetR-bla]) (Carr et al., 2012). Liquid culture medium consisted of the Lennox formulation of Lysogeny broth (LBL; 1% w/v bacto tryptone, 0.5% w/v yeast extract, 0.5% w/v sodium chloride) (Lennox, 1955) with appropriate selective agents: carbenicillin (50 µg/mL) and SDS (0.005% w/v). For tolC counter-selections, colicin E1 (colE1) was used at a 1:100 dilution from an in-house purification (Schwartz et al., 1971) that measured 14.4 µg protein/µL (Isaacs et al., 2011, Lajoie et al., 2013b), and vancomycin was used at 64 µg/mL. Solid culture medium consisted of LBL autoclaved with 1.5% w/v Bacto Agar (Fisher), containing the same concentrations of antibiotics as necessary. ColE1 agar plates were generated as described previously (Gregg et al., 2014). Doubling times were determined on a Biotek Eon Microplate reader with orbital shaking at 365 cpm at 34° C. overnight, and analyzed using a matlab script.

Oligonucleotides, Polymerase Chain Reaction, and Isothermal Assembly

PCR products used in recombination or for Sanger sequencing were amplified with Kapa 2G Fast polymerase according to manufacturer's standard protocols. Multiplex allele-specific PCR (mascPCR) was used for multiplexed genotyping of AGR replacement events using the KAPA2G Fast Multiplex PCR Kit, according to previous methods (Isaacs et al., 2011, Mosberg et al., 2012). Sanger sequencing reactions were carried out through a third party (Genewiz). CRAM plasmids were assembled from plasmid backbones linearized using PCR (Yaung et al., 2014), and CRISPR/PAM sequences obtained in Gblocks from IDT, using isothermal assembly at 50° C. for 60 minutes. (Gisbon et al., 2009).

Lambda Red Recombinations, MAGE, & CoS-MAGE

λ Red recombineering, MAGE, and CoS-MAGE were carried out as described previously (Gregg et al., 2014, Wang et al., 2009). In singleplex recombinations, the MAGE oligo was used at 1 µM, whereas the co-selection oligo was 0.2 µM and the total oligopool was 5 µM in multiplex recombinations (7-14 oligos). When double-stranded PCR products were recombined (e.g., tolC insertion), 100 ng of double-stranded PCR product was used. Since CoS-MAGE was used with tolC selection to replace target AGR codons, each recombination was paired with a control recombined with water only to monitor tolC selection performance. The standard CoS-MAGE protocol for each oligo set was to insert tolC, inactivate tolC, reactivate tolC, and delete tolC. MascPCR screening was performed at the tolC insertion, inactivation and deletion steps. All λ Red recombinations were followed by a recovery in 3 mL LBL followed by a SDS selection (tolC insertion, tolC activation) or ColE1 counter-selection (tolC inactivation, tolC deletion) that was carried out as previously described (Gregg et al., 2014).

General AGR Replacement Strategy

AGR codons in essential genes were found by cross-referencing essential gene annotation according to two complementary resources (Baba, et al., 2006, Hashimoto et al., 2005) to find the shared set (107 coding regions), which contained 123 unique AGR codons (82 AGA, 41 AGG). optMAGE (Ellis et al., 2001, Wang et al., 2009) was used to design 90-mer oligos (targeting the lagging strand of the replication fork) that convert each AGR to CGU. The total number of AGR replacement oligos was reduced to 119 by designing oligos to encode multiple edits where possible, maintaining at least 20 bp of homology on the 5' and 3' ends of the oligo. The oligos were then pooled based on chromosomal position into twelve MAGE oligo sets of varying complexity (minimum: 7, maximum: 14) such that a single marker (tolC) could be inserted at most 564,622 bp upstream relative to replication direction for all targets within a given set. tolC insertion sites were identified for each of the twelve pools either into intergenic regions or non-essential genes that met the distance criteria for a given pool. See Table 5 for descriptors for each of the 12 oligo pools.

Troubleshooting Strategy

A recalcitrant AGR was defined as one that was not converted to CGU in one of at least 96 clones picked after the third step of the conversion process. The recalcitrant AGR codon was then triaged for troubleshooting (FIG. 12A) in the parental strain (EcM2.1). First, the sequence context of the codon was examined for design errors or potential issues, such as misannotation or a disrupted RBS for an overlapping gene. In most cases, corrected oligos could be easily designed and tested. If no such obvious redesign was possible, AGR was attempted to be replaced with CGN mutations. If attempting to replace AGR with CGN failed to give recombinants, compensatory, synonymous mutations were tested in a 3 amino acid window around the recalcitrant AGR. If needed, synonymous stringency was relaxed by recombining with oligos encoding AGR-to-NNN mutations. After each step in the troubleshooting workflow, 96 clones from 2 successive CoS-MAGE recombinations were screened using allele specific PCR with primers that hybridize to the wildtype genotype. Sequences that failed to yield a wild-type amplicon were Sanger sequenced to confirm conversion. Doubling time was measured of all clones in LBL to pair sequencing data with fitness data, and chose the recombined clone with the shortest doubling time. Doubling time was determined by obtaining a growth curve on a Biotek plate reader (either an Eon or H1), and analyzed using web-based open source genome resequencing software. This genotype was then implemented in the complete strain at the end of strain construction using MAGE, and confirmed by MASC-PCR screening.

mRNA Folding and RBS Strength Computation

A custom Python pipeline was used to compute mRNA folding and RBS strength value for each sequence. mRNA folding was based on the UNAFold calculator (Markham et al., 2008) and RBS strength on the Salis calculator (Salis, 2011). The parameters for mRNA folding are the temperature (37° C.) and the window used which was an average between −30:+100 nt and −15:+100 nt around the start site of the gene and was based on Goodman et al., 2013. The only parameter for RBS strength is the distance between RBS and promoter and between 9 and 10 nt was averaged after the codon of interest based on Li et al., 2012. Data visualization was performed through a custom Matlab code.

Whole Genome Sequencing of Strains Lacking AGR Codons in their Essential Genes

Sheared genomic DNA was obtained by shearing 130 uL of purified genomic DNA in a Covaris E210. Whole genome library prep was carried out as previously described (Rohland et al., 2012). Briefly, 130 uL of purified genomic DNA was sheared overnight in a Covaris E210 with the following protocol: Duty cycle 10%, intensity 5, cycles/burst 200, time 780 seconds/sample. The samples were assayed for shearing on an agarose gel and if the distribution was acceptable (peak distribution ~400 nt) the samples were size-selected by SPRI/Reverse-SPRI purification as described in (Rohland et al., 2012). The fragments were then blunted and p5/p7 adaptors were ligated, followed by fill-in and gap repair (NEB). Each sample was then qPCR quantified using SYBR green and Kapa Hifi. This was used to determine how many cycles to amplify the resulting library for barcoding using P5-sol and P7-sol primers. The resulting individual libraries were quantified by Nanodrop and pooled. The resulting library was quantified by qPCR and an Agilent Tapestation, and run on MiSeq 2×150. Data was analyzed to confirm AGR conversions and to identify off-target mutations using Millstone, an web-based open-source genome resequencing tool.

NNN-Sequencing and CRISPR

CRISPR/Cas9 was used to deplete the wildtype parental genotype by selectively cutting chromosomes at unmodified target sites next to the desired AGR codons changes. Candidate sites were determined using the built-in target site finder in Geneious proximally close to the AGR codon being targeted. Sites were chosen if they were under 50 bp upstream of the AGR codon and could be disrupted with synonymous changes. If multiple sites fulfilled these criteria, the site with the lowest level of sequence similarity to other portions of the genome was chosen. Oligos of a length of ~130 bp were designed for all 24 genes with an AGR codon in the first 30 nt after the translation start site. Those oligos incorporated both an NNN random codon at the AGR position as well as multiple (up to 6) synonymous changes in a CRISPR target site at least 50 nt downstream of an AGR codon. This modifies the AGR locus at the same time as disrupting the CRISPR target site, ensuring randomization of the locus after the parental genotype is deleted. Recombinations were performed in the parental strain EcM2.1 carrying the Cas9 expressing plasmid DsCas9. For each of 24 genes, five cycles of MAGE were performed with the specific mutagenesis oligo at a concentration of 1 uM. CRISPR repeat-spacer plasmids carrying guides designed to target the chosen sites, and were electroporated into each diversified pool after the last recombineering cycle. After 1 hour of recovery, both the DsCas9 and repeat-spacer plasmids were selected for, and passaged in three parallel lineages for each of the 24 AGR codons for 144 hrs. After 2 hours of selection, and at every 24 hour interval, samples were taken and the cells were diluted 1/100 in selective media.

Each randomized population was amplified using PCR primers allowing for specific amplification of strains incorporating the CRISPR-site modifications. The resulting triplicate libraries for each AGR codon were then pooled and barcoded with P5-sol and P7-sol primers, and run on a MiSeq 1×50. Data was analyzed using custom Matlab code.

For each gene and each data point, reads were aligned to the reference genome and frequencies of each codon were computed. In FIG. 23, the mRNA structure deviation (red line) and RBS strength deviation (blue line) in arbitrary units were computed based as the product of the frequencies and the corresponding deviation for each codon.

Example III

Genome Engineering Toolkit and Multi-Locus Validation Experiment

Figure 36A:
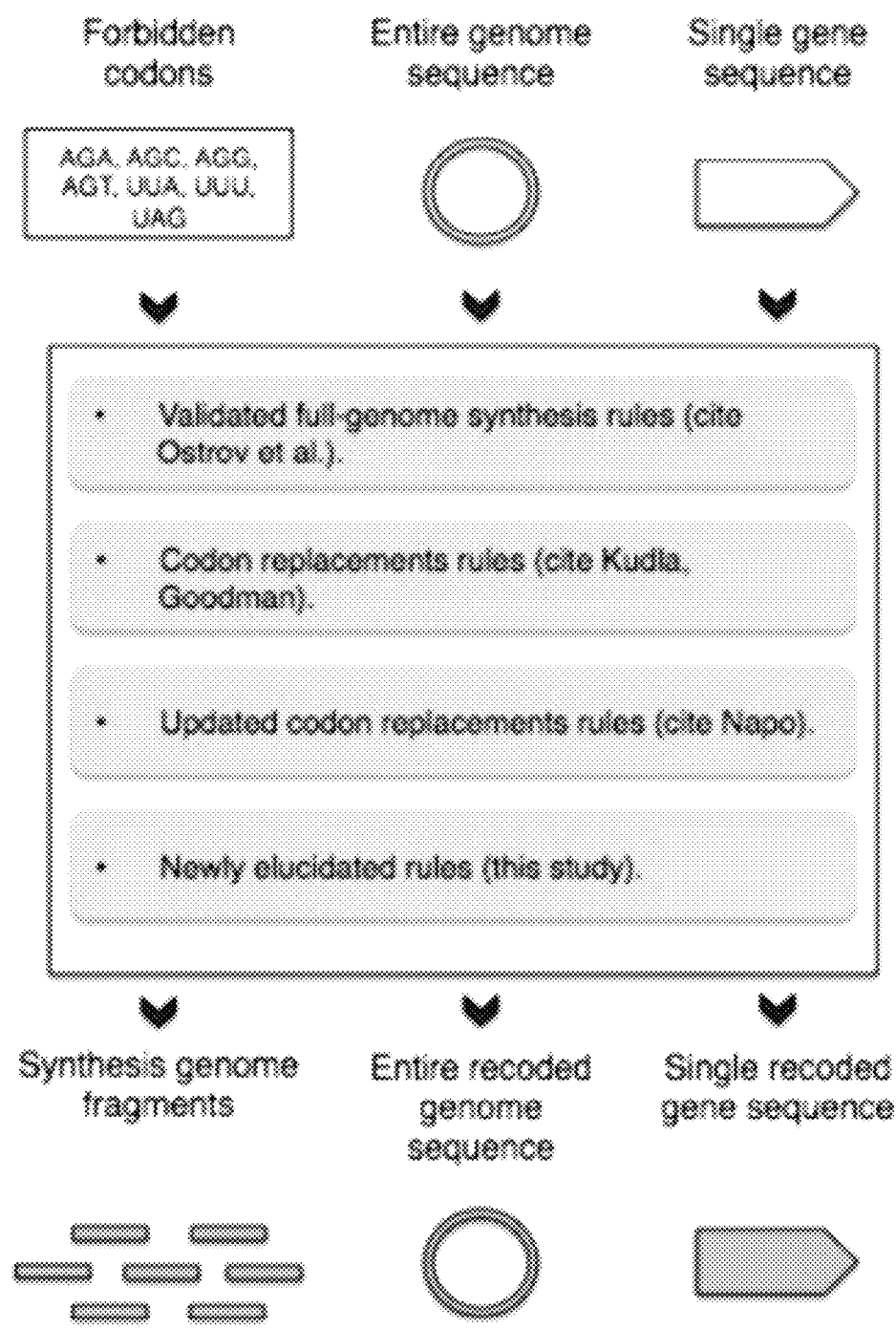
FIG. 36A is a schematic depicting various method steps of embodiments of the present disclosure.

Methods described herein make use of the Genome Engineering Toolkit (GETK), a software library for reassigning codons genome-wide. GETK software supports design and synthesis of recoded genes and whole genomes (FIG. 36A). The software takes into account biophysical constraints to choose the best codon reassignment, minimizing the risk of redesigned organisms that are impaired or inviable. Using software encoding methods described herein, experiments were we carried recoding positions throughout the genome and demonstrating that the codon choices specified by the methods described herein reduce the risk of design exceptions.

Figure 36B:
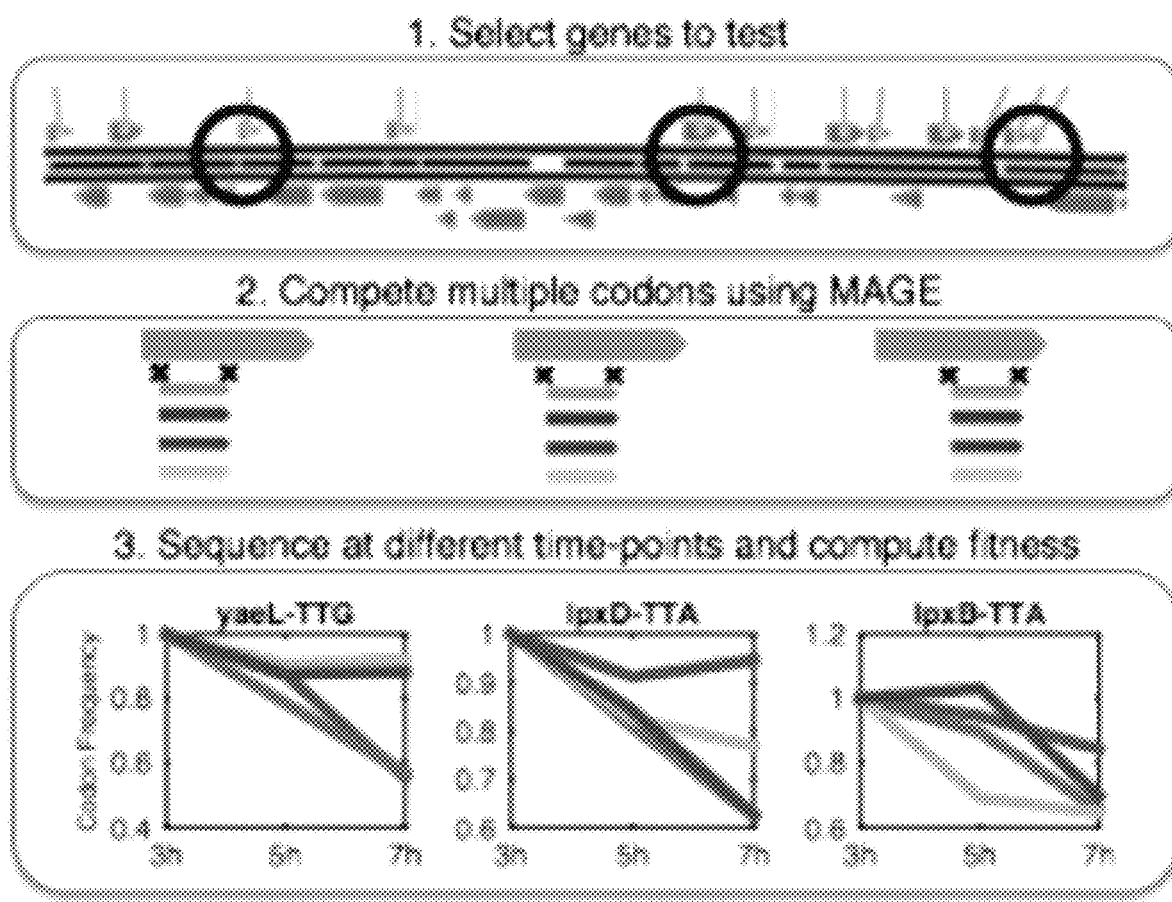
FIG. 36B is a graph depicting the experimental procedure where alternative codons are introduced via MAGE at different positions in the genome. The population is then maintained at mid-logarithmic phase growth while sampling at regular intervals. Codon fractions are plotted vs time and a logarithmic decay function is fitted and the decay constant indicates fitness.

To validate the design rules described herein, an experiment was carried out to test synonymous codon substitutions throughout the genome. 235 codon competition experiments were designed, and prioritized according to the predicted difficulty of codon replacement. Positions were selected where at least one of mRNA, RBS, or internal RBS were predicted by the design rules to be significantly disrupted for at least one alternative codon. The 6 forbidden sense codons as in Example I were considered: AGA (Arg), AGG (Arg), AGC (Ser), AGU (Ser), UUG (Leu), and UUA (Leu). Positions were prioritized where the design rule-predicted score max_{mRNA|RBS|internal_RBS} exceeded a threshold, or at least one bad recoding existed. For each sub-experiment, MAGE oligos were designed that introduce synonymous codons at the target. For some sub-experiments, MAGE oligos were designed that introduce non-synonymous mutations. Each sub-experiment was performed in a separate well and MAGE was used to electroporate the oligo set for that sub-experiment. The population was sampled at regular intervals and diluted to maintain logarithmic-phase growth. The samples were sequenced and used to quantify codon abundance, which was then used to calculate relative fitness (FIG. 36B).

Figure 36C:
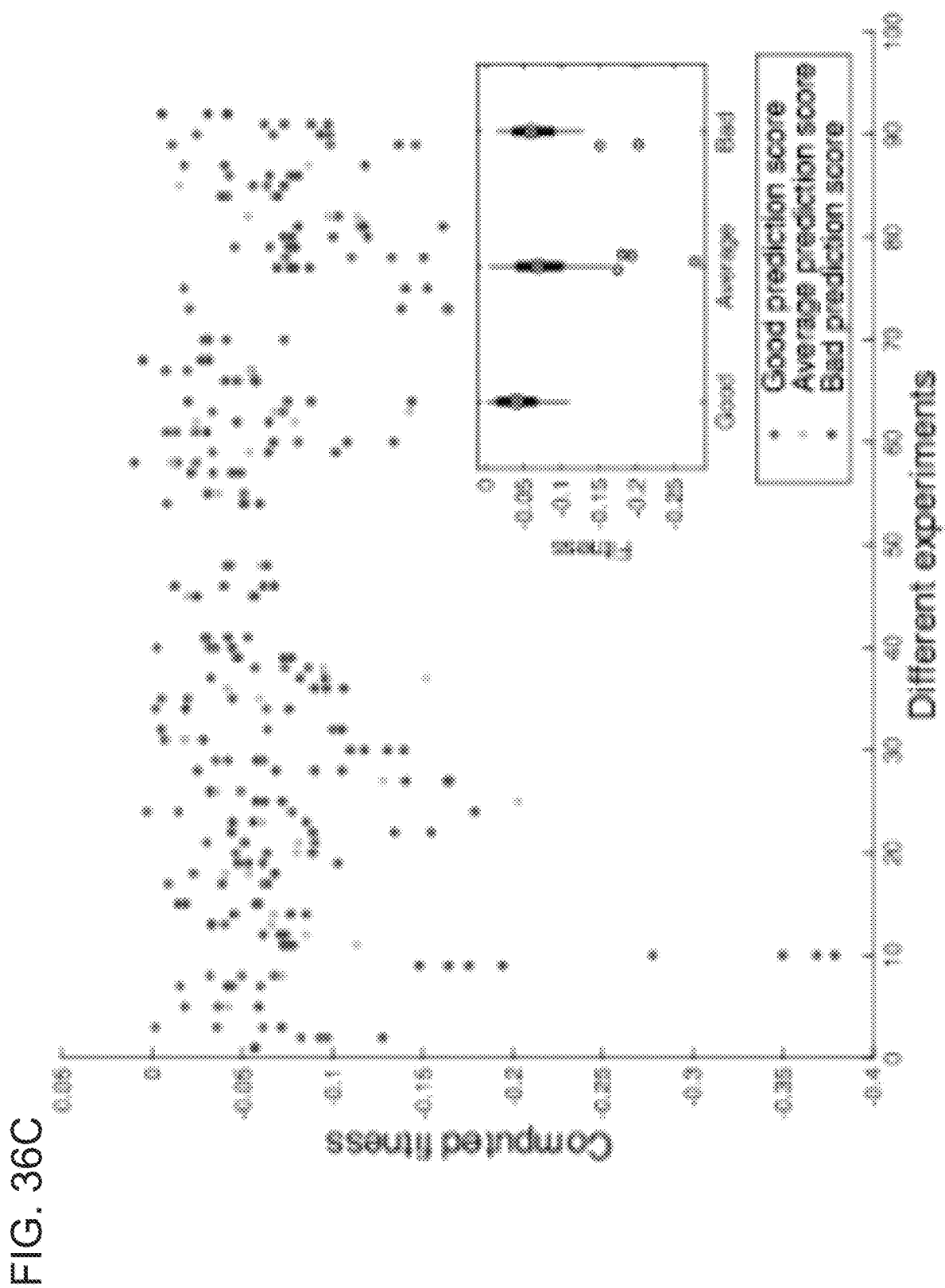
FIG. 36C compares the experimentally-measured fitness to the predicted GETK score. Each position on the x-axis corresponds to one of 95 sub-experiments testing a different genomic position. Position on the y-axis indicates fitness relative to wild-type, with more negative value indicating worse fitness and 0 indicating wild-type fitness. Inset shows fitness of measured codons grouped by good, average, or bad GETK scores. Examples with good predicted score have significantly better fitness.
Figure 37:
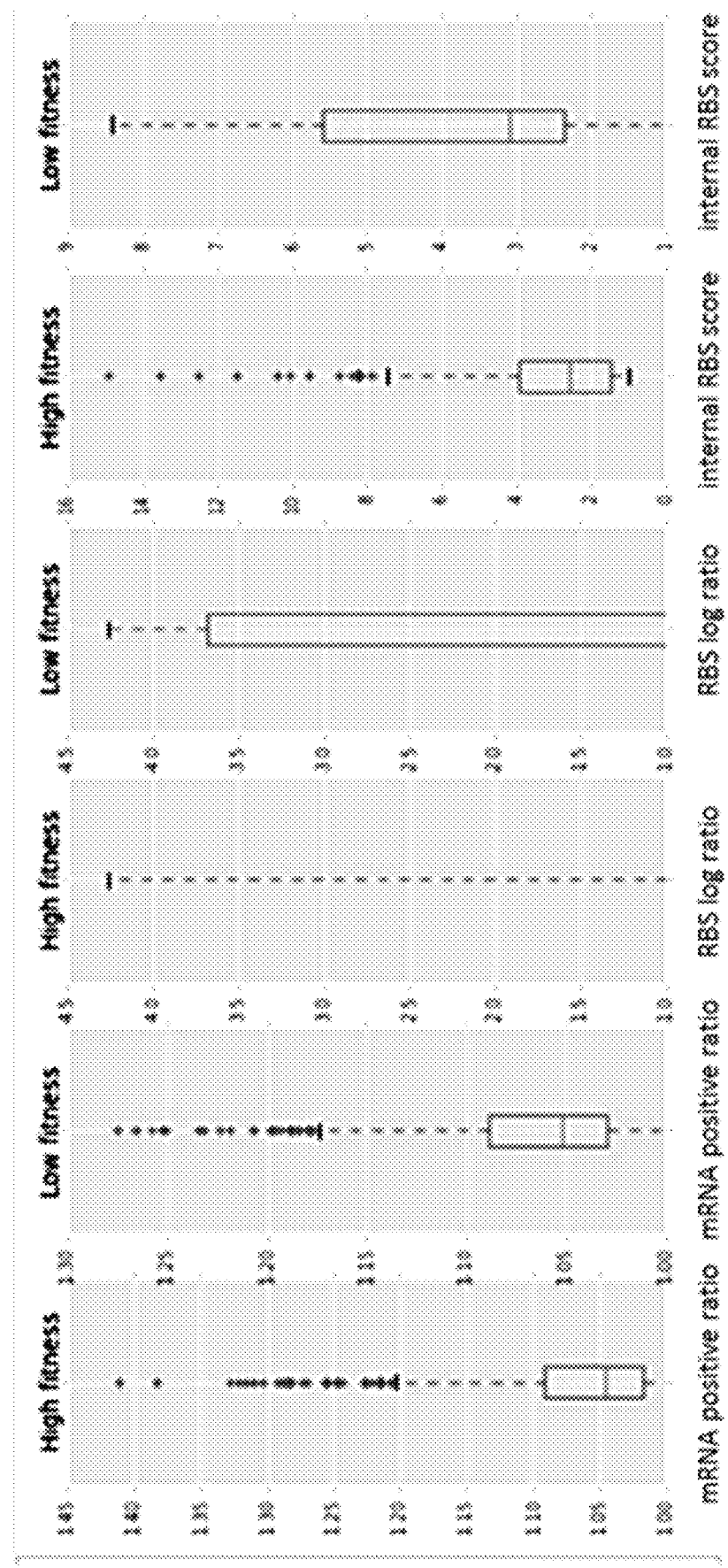
FIG. 37 shows a summary of results of 62 sub-experiment testing combinations of proximal codon changes near the 5-prime ends of various genes. A library of oligos was designed with degeneracy at codon positions within the 90-mer oligo window. Sub-experiment results are presented together, but separated by codon combinations with good fitness (<7% fitness defect) or bad fitness (>13% fitness defect). A pair of good-bad fitness summaries is plotted for each of three GETK scoring metrics: change in 5-prime mRNA folding strength, change in upstream RBS motif strength, change in internal RBS motif strength. For each metric, a lower score indicates less predicted disruption of the respective motif.

Predicted scores were compared to experimental fitness measurements (FIG. 36C). Our experiments reveal that alternative codon predictions can minimize design issues. In the case of testing single codon changes at the 5-prime ends of essential genes, codons categorized as having good scores (minimal predicted disruption of mRNA folding, ribosome binding site strength, and internal ribosome pausing sites) result in significantly less fitness impact (K-S test). Testing combinations of codon swaps within the same 90-mer oligo window showed even stronger correspondence between predicted scores and observed fitness (FIG. 37).

Figure 38:
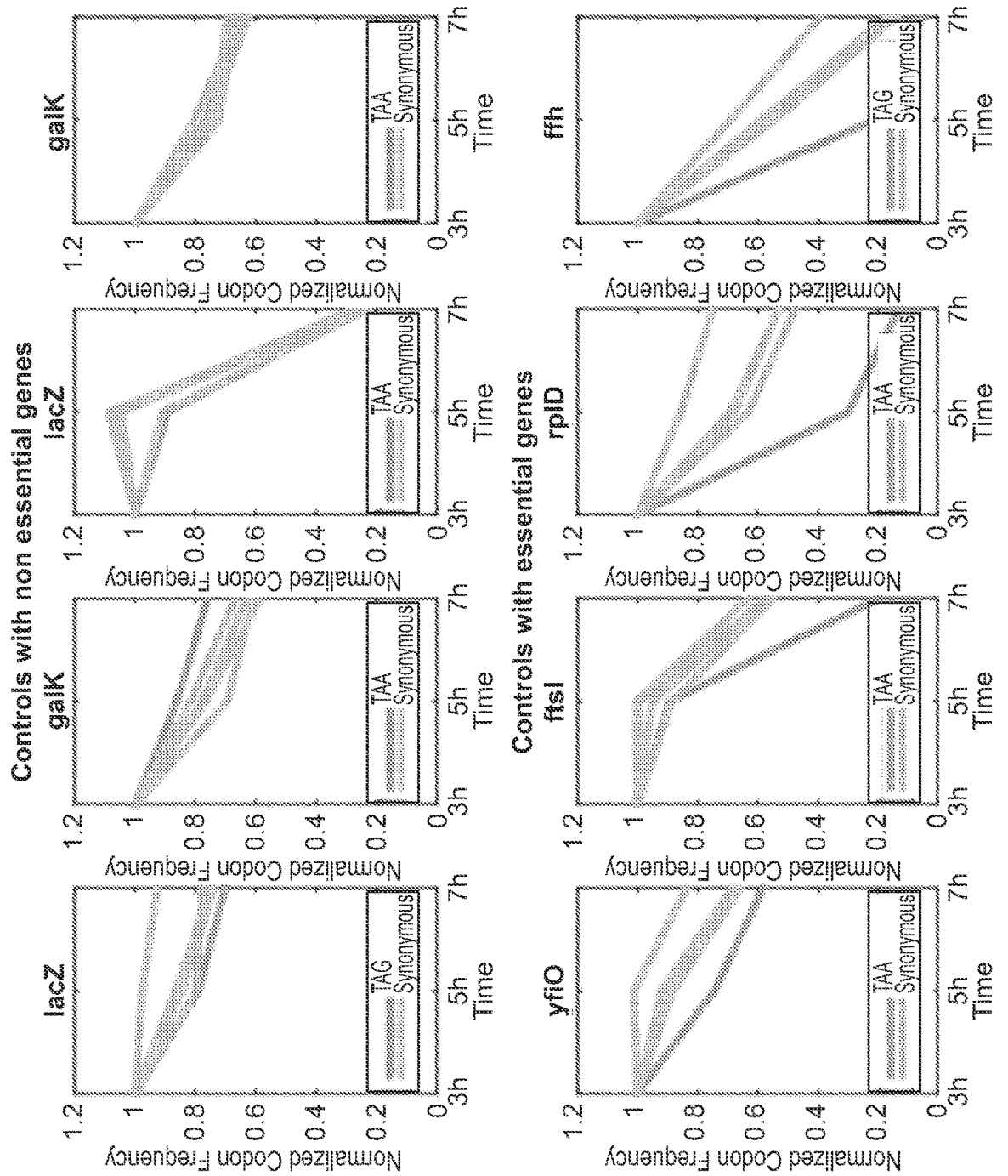
FIG. 38 illustrates alternative codon trajectories for controls. Top row shows null-effect controls, where synonymous codons and early stop codons were introduced into non-essential genes LacZ and GalK at multiple positions, and showing similar effect between synonymous codons and internal stops. Bottom rows shows strong-effect controls, where synonymous codons and internal stop codons were introduced into essential genes. These show a marked difference between internal stop and synonymous codons, with a greater dynamic range of codon preference at some positions.

As a null-effect controls, synonymous codons and early stop codons were introduced into non-essential genes LacZ and GalK at multiple positions, showing similar effect between synonymous codons and internal stops (FIG. 38, top row). As strong-effect controls, synonymous codons and internal stop codons were introduced into essential genes. These show a marked difference between internal stop and synonymous codons, with a greater dynamic range of codon preference at some positions (FIG. 38, bottom row).

Figure 39:
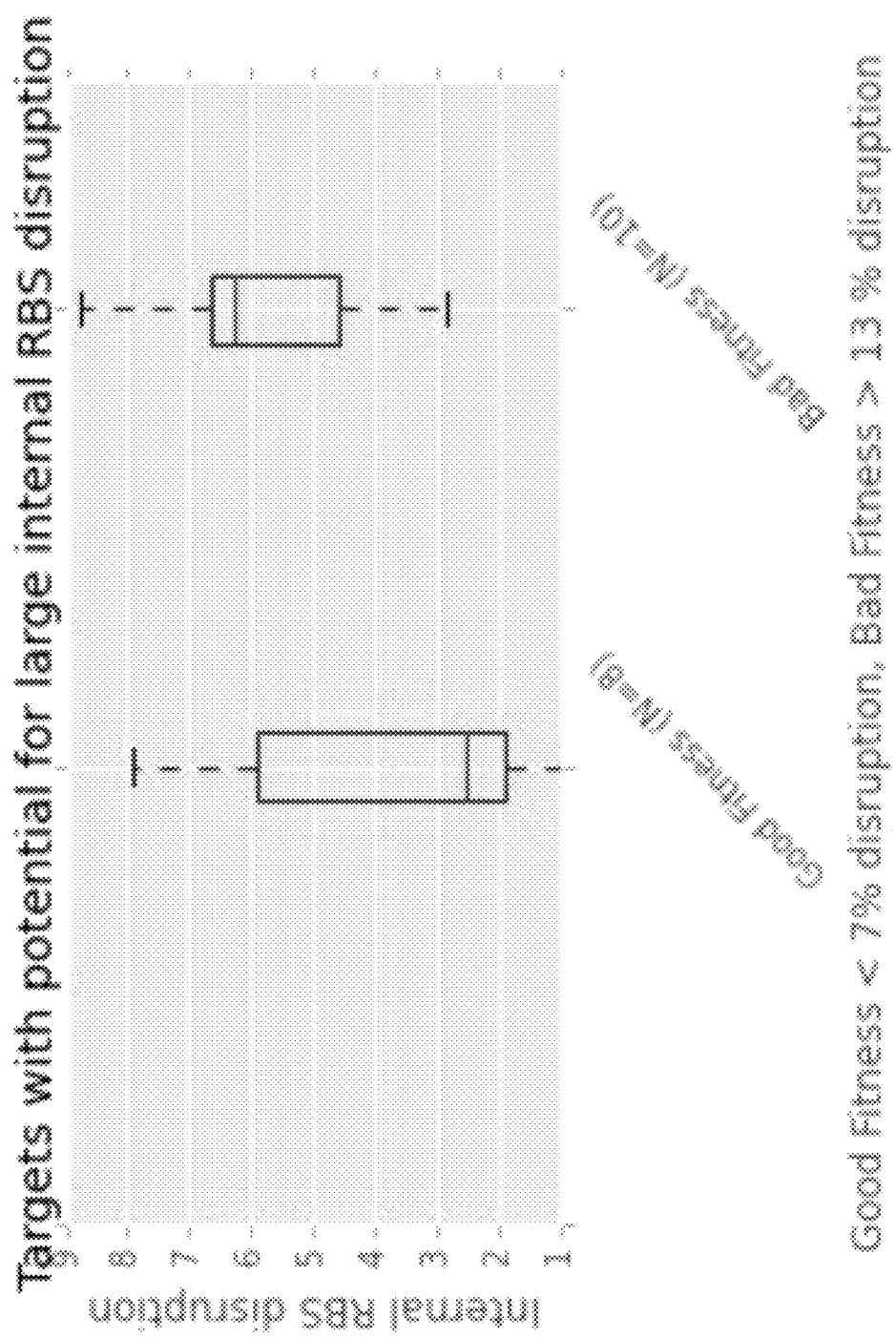
FIG. 39 summarizes results from testing non-synonymous and synonymous mutations observed in phylogenetically-close neighbors of E. coli in gammaproteobacteria at specific positions internal to genes (not limited to 5-prime end). These positions were prioritized according to whether internal RBS for some alternatives were predicted by GETK to be disruptive. Internal RBS score is shown to be a strong predictor of fitness of alternative allele choices.
Figure 40:
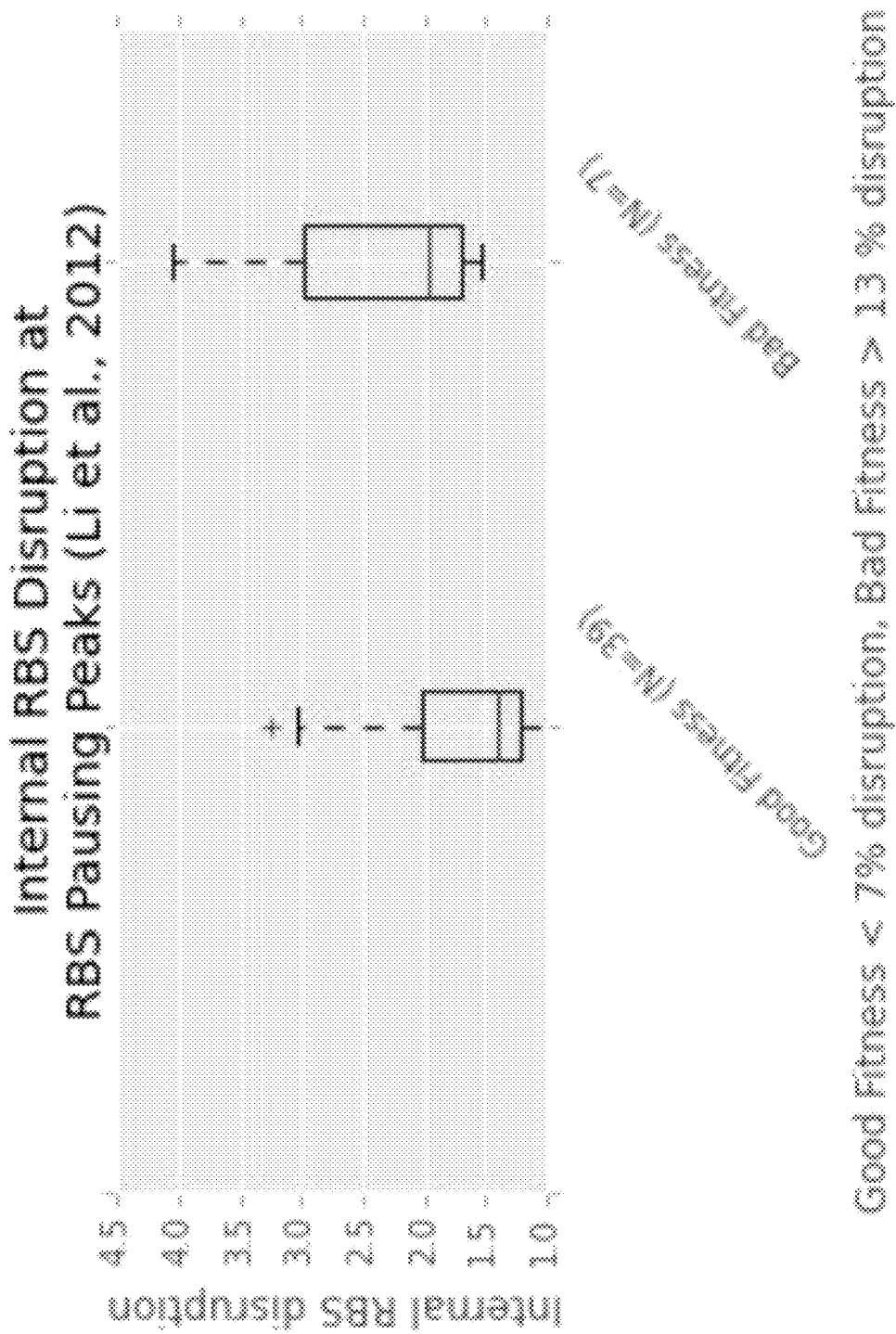
FIG. 40 shows results from testing a mix of non-synonymous mutations predicted by conservation. These positions were prioritized according to peaks of ribosomal pausing as reported by (Li et al., 2012). Internal RBS score is shown to be a strong predictor of fitness of alternative allele choices.

Beyond testing synonymous substitutions, non-synonymous substitutions observed in phylogenetic neighbors of $E.$ $coli$ (gammaproteobacteria, e.g. $Salmonella\ enterica$) that score well according to the rules described herein were tested for ability to replace codons. Preventing disruption of internal RBS motifs is an effective rule for selecting codons internal to genes, both for loci with potential high RBS disruption (FIG. 39) (Kolmogorov-Smirnov p=3E−14) and for loci observed to have strong ribosomal pausing peaks (Li et al., 2012) (FIG. 40) (Kolmogorov-Smirnov p=7.9E−05).

Choosing Genomic Locus Targets

Targets for the 235-Codon Competition Experiments were Organized into Three 96-Well Plates:

Plate 1: Single Codon Changes in 5-Prime of Essential Genes 95 codons were chosen that occur near the 5-prime end of essential genes, (−30, +100) bases relative to the start codon. Positions were considered where the worst possible score exceeds thresholds for at least one filter (poor RBS or mRNA folding prediction), as described by the filter:

single_codon_any_bad_max=single_codon_agg_data_df[
      (single_codon_agg_data_df['max_RBS_log_
        ratio']>3.3)|
      (single_codon_agg_data_df['max_mRNA_posi-
        tive_ratio']>1.1)|
      (single_codon_agg_data_df['max_internal_RBS_s-
        core']>4.1)]

The threshold values were chosen as follows:

RBS_log_ratio: 3.3=1+math.log_e(10)
mRNA_positive_ratio: 1.1=10% deviation
max_internal_RBS_score: 4.1=3.3+a bit more to get down to <96-well plate The candidate set contains targets with at least one problem in the design (i.e. the worst design is bad). At least two of these targets introduce non-synonymous mutations into overlapping genes, allowing testing the aspect of the software that balances amino acid sense against preservation of regulatory gene expression signals.

Plate 2: Combos of Codon Changes and Adjacent Degenerate Tests

From among the single changes, those that occur adjacent to others within a 90-basepair oligonucleotide size were combined into a new set of sub-experiments that tested all combinations of adjacent oligos. There were 62 such targets.

12 sub-experiments were designed with synonymous codon swaps in non-forbidden codons adjacent to forbidden codons. Oligos were designed that bring in all synonymous codon swaps on either side of some choice forbidden codons, e.g. the region surrounding an arginine V-R-G might look like GTN-CGN-GGN in an oligo. For these, recodings were targeted which have a score that exceeds threshold values with the best synonymous codon swap, where even the best synonymous solution is bad.

Plate 3: Testing Phylogenetic Conservation

The final 66 sub-experiments were designed to test phylogenetic conservation as a source of permitted non-synonymous substitutions. Seven strains of gammaproteobacteria were aligned and codons were identified that have non-synonymous variants relative to *E. coli*. Targets were tested around the 5-prime ends of essential genes as well as targets in the middle of essential genes. For conservation 5-prime targets, a subset was chosen of non-synonymous changes observed in phylogenetic conservation data for which there is a possible bad score, as described by:

```
conservation_5_prime_non_synonymous_df = conservation_5_prime_df[
    (conservation_5_prime_df['replacement_codon'].apply(
        lambda c: c not in FORBIDDEN_CODONS)) &
    (~conservation_5_prime_df['is_synonymous'])][:]
conservation_5_prime_synonymous_only_bad_df =
conservation_5_prime_non_synonymous_df[
        (conservation_5_prime_non_synonymous_df['max_mRNA_positive_ratio'] >
1.1) |
        (conservation_5_prime_non_synonymous_df['max_RBS_log_ratio'] > 3.3) |
        (conservation_5_prime_non_synonymous_df['max_internal_RBS_score'] > 4.1)
][:]
conservation_5_prime_first_30nt_bad_score =
conservation_5_prime_non_synonymous_df[
        (conservation_5_prime_non_synonymous_df['codon_start'] < 30) &
        ((conservation_5_prime_non_synonymous_df['mRNA_positive_ratio'] > 1.1) |
        (conservation_5_prime_non_synonymous_df['RBS_log_ratio'] > 3.3) |
        (conservation_5_prime_non_synonymous_df['internal_RBS_score'] > 3.3))
][:]
conservation_5_prime_targets_df = pd.concat([
    conservation_5_prime_synonymous_only_bad_df,
    conservation_5_prime_first_30nt_bad_score])
conservation_5_prime_targets_df.drop_duplicates(inplace=True)
```

These selections were competed against the corresponding single codon degenerate oligo from plate 1.

For conservation in middle of genes, the ~3500 candidate targets in essential genes were reduced using two criteria: 1) internal RBS score with a bad potential maximum with synonymous changes and 2) locations of peaks from ribosomal pausing data (Li et al., 2012).

For internal RBS, 12 targets at 9 unique positions were chosen, for a total of 21 oligos. This filter used is:

```
conservation_middle_of_genes_df = conservation_essentals_df[
    (conservation_essentals_df['codon_start'] > 30) &
    (conservation_essentals_df['scoring_gene'] ==
        conservation_essentals_df['codon_gene']) &
    (conservation_essentals_df['replacement_codon'].apply(
        lambda c: c not in FORBIDDEN_CODONS)) &
    (~conservation_essentals_df['is_synonymous']) &
    (conservation_essentals_df['max_internal_RBS_score'] > 6.5) &
    (conservation_essentals_df['internal_RBS_score'] <
        conservation_essentals_df['min_internal_RBS_score'])
][:]
```

For Weissman, 14 targets at 9 unique positions, or 23 oligos were chosen.

Oligonucleotides were designed as described in (Wang et al., 2009). DNA was synthesized by industrial partners IDT DNA technologies (Coralville, Iowa).

Strains & Culture

EcM2.1 naïve strains were used for the competition experiment (EcM2.1 is a strain optimized for MAGE—*Escherichia coli* MG1655 mutS_mut dnaG_Q576A exoX_mut xonA_mut xseA_mut 1255700::tolQRA Δ(ybhB-bioAB)::[λcI857 N(cro-ea59)::tetR-bla]).

Liquid culture medium consisted of the Lennox formulation of Lysogeny broth (LB$^L$; 1% w/v bacto tryptone, 0.5% w/v yeast extract, 0.5% w/v sodium chloride) with appropriate selective agents: carbenicillin (50 μg/mL). Solid culture medium consisted of LB$^L$ autoclaved with 1.5% w/v Bacto agar (Thermo Fisher Scientific Inc.), containing the same concentrations of antibiotics as necessary.

Experiment Setup

The recombineering experiments using the EcM2.1 strain were carried out as described previously, and in the same conditions for all different competition experiment. Depending on the experiment, the total oligo pool was adjusted to a maximum of 5 μM.

After transformation of the oligos, cells were taken out at 1, 3, 5, 7 and 24 hrs to be sequenced. Dilution were performed so as to maintain cells in constant log phase. At each timepoint, cells were plated on permissive media so as to count the number of cells present in the pools. Based on these numbers, we were able to compute the number of doublings between each timepoint.

| Timepoint | # of Doublings |
|---|---|
| 1 hr | 1 |
| 3 hr | 3 |
| 5 hr | 7 |
| 7 hr | 10 |

Sequencing

Each population was amplified and barcoded with Illumina P5 and P7 primers, pooled, and sequenced using a MiSeq or NextSeq using a PE-150 kit. Reads were demultiplexed to the reference genome and frequencies of each codon were computed for each sub-experiment.

Estimating Relative Allele Fitness and Scoring

For each sub-experiment, the relative frequency of each codon was calculated. Then the fractions were normalized relative to the fraction at the first timepoint. Then, for each codon, the fitness was inferred by fitting a logarithmic function to the codon fraction across all time points and taking the decay constant as a measure fitness. The mRNA structure deviation and RBS strength deviation were computed using GETK and scores were compared to empirically measured fitness.

TABLES

TABLE 1

| | | Genome Design Rules - Biological Constraints | |
|---|---|---|---|
| | Rule | Motivation | Implementation |
| A | Fix gene overlaps: Perform minimal synonymous codon swaps required to properly recode both overlapping genes. If necessary - separate by duplicating overlapping regions [202 instances] | Forbidden codons may fall in the overlapping region of two genes. Sometimes it may be possible to remove forbidden codons through synonymous swaps alone. In other cases, in order to avoid introducing nonsynonymous mutations or disrupting regulatory motifs such as ribosome binding sites (RBS), it is necessary to separate the genes first so that codons in each gene can be replaced independently. | Use synonymous codon swaps (Genbank annotation: adj_base_ov) to avoid introducing on synonymous changes in overlapping genes. Use computational RBS motif strength prediction to maintain RBS motif. In short gene overlaps, attempt to minimize editing, for example reduce 4 nucleotide overlap to 1 nucleotide (see FIG. 9A (i)) If minimal overlap fix does not preserve RBS motif, separate the overlap by copying the overlapping sequence and 15-20 base pairs upstream, to preserve native RBS (see FIG. 9A (ii)) Genbank annotation: fix_overlap. |
| | Reduce homology between duplicated regions through non-disruptive shuffling of copied region | To separate overlapping genes, the sequences are duplicated, creating two tandem paralogous regions. These two paralogs have the potential to recombine spontaneously which could cause a disruptive change in either the upstream or downstream gene. This spontaneous recombination was prevented by shuffling the codons of the upstream paralog, thus maintaining the native nucleotide sequence of the N-terminus of the downstream gene and 15-20 bases upstream. This region has shown to be important for mRNA folding and translation initiation | Perform synonymous codon swaps in copied regions to reduce homology while maintaining regulatory motifs. (Genbank annotation: adj_base_ov) |
| B | Preserve 5-prime mRNA secondary structure of genes | Gene expression is affected by mRNA secondary structure | Use thermodynamics-based secondary structure prediction to compare mRNA free energy (ΔG) of wild-type and recoded sequence. Minimize ΔG change across 40-bp windows centered at modified codons. |
| | Preserve GC content | Related to DNA stability, mRNA secondary structure. | Maintain GC content when choosing among alternative codons. Minimize ΔGC across 40 base pair windows centered at modified codons. |
| | Rebalance codon usage | Preserve codon usage bias for remaining 57 codons in order to preserve expression dynamics that are dependent on aa-tRNA availability. | Ensure selection of alternate codons is consistent with global distribution of codon choice; both for recoding and heterologous expression. |

TABLE 2

Genome Design Rules - Synthesis Constraints

| | Rule | Motivation | Implementation |
|---|---|---|---|
| C | Remove repetitive (REP) sequences [132 instances] | REP regions were found to be over-enriched in DNA fragments that failed the repetitiveness metric for commercial synthesis and/or failed during synthesis. Hypothesizing that these REP elements were used as transcriptional terminators, it was tested whether they could be replaced with synthetic terminator sequences (data not shown). It was found that REP sequences could be replaced with synthetic transcriptional terminators with no measurable effect. | Replace each REP sequence with unique terminator sequence drawn from orthogonal set. Note that not all REPs were deleted as some were tolerated for DNA synthesis. Genbank annotation: rep_to_term. |
| D | Remove restriction sites needed for synthesis [AarI: 972 instances, BsaI: 182 instances, BsmBI: 954 instances] | DNA synthesis vendor constraint | Disruption of restriction enzyme motifs using synonymous codon swaps. (Genbank annotation: adj_base_RE) Preserve functional RNA (e.g. rRNA) secondary structure when necessary. If outside of coding regions, change single nucleotides to avoid disrupting annotated regulatory motifs. (Genbank annotation: adj_base_RNA) |
| E | Remove homopolymer runs [158 instances] | DNA synthesis vendor constraint: remove sequence of more than 8 consecutive A, C, T or more than 5 consecutive G | In coding sequence, synonymous codon swaps were performed. In intergenic sequence, minimal nucleotide changes were performed that avoid disrupting annotated regulatory motifs. (Genbank annotation: adj_base_hp) |
| NA | Rebalance GC content extremes | DNA synthesis vendor constraint: 0.30 < GC < 0.75. | If coding sequence contains very high/low GC content, use synonymous codon swaps to normalize GC content. Genbank annotation: adj_base_GC) If intergenic sequences contains high/low GC content, introduce minimal nucleotide changes to avoid disrupting annotated regulatory motifs. (Genbank annotation: adj_base_GC) |
| F | Partition genome into 87 50-kb "segments" at operon boundaries | Splitting operons were avoided so that segments remain modular and can be redesigned independent of each other. | Allow ±5 kb variability in segment size to find partitioning that keep whole operons together. Genbank annotation: segment. |
| G | Partition each "segment" into ~15 synthesiscompatible fragments of 2-4 kb with 50 bp overlaps between adjacent fragments | 2-4 kb was used as the primary synthesis unit, as offered by vendors. 50 bp overlaps enable homologous-recombination based assembly in S. cerevisiae. | Choose partitioning to minimize secondary structure at 50 base pair overlaps to maximize success rate in yeast assembly. Genbank annotation: synthesis_frag. |

TABLE 3

Primers used for PCR of kanamycin cassette for chromosomal deletion. Forward primers disclosed as SEQ ID NOS 1-87, respectively, in order of appearance, and reverse primers discolsed as SEQ ID NOS 88-174, respectively, in order of appearrance.

| Casserte | Forward primer | Reverse primer |
|---|---|---|
| KanDeletion-seg0 | GAA AAA AAT ATC ACC AAA TAA AAA ACG CCT TAG TAA GTA TTT TTC CTG ATC CTT CAA CTC AGC AAA AGT TC | TGC ATA TAT TCC CCA AAT CGA CAC ACG GAT ATC AGG GCT ATC TCC TTA TTA GAA AAA CTC ATC GAG CAT CAA ATG |
| KanDeletion-seg1 | CAA TTG ACC GCA GCC GGA AAA CGG TAA AAG CAC CTT TAT ATT GTG CTG ATC CTT CAA CTC AGC AAA AGT TC | ATA GTC AGG AAT AGT CTT ATT TAC TTT AAG CAT ATT GAT GTC CAG TTA TTA GAA AAA CTC ATC GAG CAT CAA ATG |
| KanDeletion-seg2 | AAA TAC GCG CCA GGT GAA TTT CCC TCT GGC GCG TAG AGT ACG GGA CTG ATC CTT CAA CTC AGC AAA AGT TC | TCA CCG GGC ATT GTG TCG TTT ATG CGC AGC GCG TGC GCT GAC TTT TTA TTA GAA AAA CTC ATC GAG CAT CAA ATG |

TABLE 3-continued

Primers used for PCR of kanamycin cassette for chromosomal deletion. Forward primers disclosed as SEQ ID NOS 1-87, respectively, in order of appearance, and reverse primers discolsed as SEQ ID NOS 88-174, respectively, in order of appearrance.

| Casserte | Forward primer | Reverse primer |
| --- | --- | --- |
| KanDeletion-seg3 | TAC ACC GAG AAA GCC GAT GGG GTG ATT TTC CAG ACT GCG GTT AAC TG ATC CTT CAA CTC AGC AAA AGT TC | CGT CTG AAC TGC CGC CCG AAA GTA ACG ATG CTG GAA CTG GTG TAG TTA TTA GAA AAA CTC ATC GAG CAT CAA ATG |
| KanDeletion-seg4 | AAA TCA AAA AAT TAC CTG CTT TAT TCT GGT GAT AAA ATT CAC GAT CTG ATC CTT CAA CTC AGC AAA AGT TC | CAC TCT TTC AAC GAG CAA TTG TAT ATT GTT ATG TAA GCA AGT GCT TTA TTA GAA AAA CTC ATC GAG CAT CAA ATG |
| KanDeletion-seg5 | TGC GAT TTA ATG TTC TCC ATA ATG AGC AAA ATT CTG ACC GGT GTA CTG ATC CTT CAA CTC AGC AAA AGT TC | CCT ACA GAT TCT TGC GCC ATT CGT AGG CCG GAT AAG GCG TTC ACG TTA TTA GAA AAA CTC ATC GAG CAT CAA ATG |
| KanDeletion-seg6 | TGC GAA CGT TAC GGC GTC TGA CCT ACA TGT TCA TGC CGG ATG CGG CTG ATC CTT CAA CTC AGC AAA AGT TC | GTG TAT GGA AAA TCA GAA AAC TCA CAA ATC CTG ATG ACT TTC TTA TTA GAA AAA CTC ATC GAG CAT CAA ATG |
| KanDeletion-seg7 | GAA AGC CGG ACG TAA CCG CAC CGA AGT GGC GGC CTG ACG TCC GGC CTC ATC CTT CAA CTC AGC AAA AGT TC | TTG TCA CTC TAA TGA TAA TTA TTT GTT AAA TAA TTG TTT TAT TTC TTA TTA GAA AAA CTC ATC GAG CAT CAA ATG |
| KanDeletion-seg8 | GGG AGT GCT GAA GGA GTC TGG GCG GGC AAT TGG TAT AAC CAA TGT CTG ATC CTT CAA CTC AGC AAA AGT TC | AAA CGA TAC CAC CAA CAG GCG ATT GCC TCA AGA AAG GCA CCT GGG TTA TTA GAA AAA CTC ATC GAG CAT CAA ATG |
| KanDeletion-seg9 | TCA TCT GCA CTT TCC GCA AAT TAT CTC GCC ATT AAC CGT TTC AGC CTG ATC CTT CAA CTC AGC AAA AGT TC | ATC CGG TAC CCA TTG TAG GCC TGA TAA GAT GCG TCA AGC ATC GCA TTA TTA GAA AAA CTC ATC GAG CAT CAA ATG |
| KanDeletion-seg10 | GCC TAC AAC CGG TGC CGC ATC CGG CAA TTG GTG CAC AAT GCC TGA CTG ATC CTT CAA CTC AGC AAA AGT TC | CAG CGC CAT GCA AGT GCT GGA TAG GCT TAA GGC GCT GTT TTA AGC TTA TTA GAA AAA CTC ATC GAG CAT CAA ATG |
| KanDeletion-seg11 | ATT TTC GCC AGA GGC CGC CGC AGG TGA CAG CGT CCG ACA GTT AAT CTG ATC CTT CAA CTC AGC AAA AGT TC | CAG ACA CGA CTT TGT AGA AAT TGT TTT ACA AAA ATG GCG ATG CAA TTA TTA GAA AAA CTC ATC GAG CAT CAA ATG |
| KanDeletion-seg12 | AAT CGG CTT TCG AAA GTG GGC TAT CAT CCC ACC CCG CGC CGC AGA CTG ATC CTT CAA CTC AGC AAA AGT TC | GTG AAC GCC TTA TCC GGC CTA CAA AAT CGC TTA AAT TCA ATA TAT TTA GAA AAA CTC ATC GAG CAT CAA ATG |
| KanDeletion-seg13 | AAT TGC CTG ATG CGC TAC GCT TAT CAG GCC TAC GAG GAT GGT GCA CTG ATC CTT CAA CTC AGC AAA AGT TC | TAA GGT AAC TTT AGT GAC ATT TAT GTT TAA AAT GTG TGA GTT ATA TTA GAA AAA CTC ATC GAG CAT CAA ATG |
| KanDeletion-seg14 | CGT CTC TTT TTA TCT TTA ATT GCC AAC CGA AAC TAA TTT CAG CCT CTG ATC CTT CAA CTC AGC AAA AGT TC | GTT TAT GCC GGA TGC GGC GTG AAC GCC TTA TCC GGC CTA CAA ACC TTA TTA GAA AAA CTC ATC GAG CAT CAA ATG |
| KanDeletion-seg15 | CGC TTA TCA GGC CTA CAT TTT CTC CGC AAT ATA TTG AAT TTG CGC CTG ATC CTT CAA CTC AGC AAA AGT TC | GGC TAA ATC ATT CAC ATC ATC AAT TTC ATC CTT ACT TTC ATT CGA TTA TTA GAA AAA CTC ATC GAG CAT CAA ATG |
| KanDeletion-seg16 | CCG TAA CAG TGT AAT AAC AAT GTG ACG CAG AGC ACA AAT TAT ATT CTG ATC CTT CAA CTC AGC AAA AGT TC | CTA AGC TTC GAT CT CAA AAG CAT TAT CAG ACT GAT ACG CTA TTA TTA GAA AAA CTC ATC GAG CAT CAA ATG |
| KanDeletion-seg17 | CGA TCG CTC TGA AAG CGT TCT ACG ATA ATA ATG ATA TCC TTT CAA CTG ATC CTT CAA CTC AGC AAA AGT TC | AAA ACG GCT CAG ATC TGC CAG AGT CAG CGT CAC CGA CCA CAA TAA TTA GAA AAA CTC ATC GAG CAT CAA ATG |
| KanDeletion-seg18 | GGA CTG ATA TTC CCG CTG CTG GCG CGT AAA GCG AAT AGT AAA TAA CTG ATC CTT CAA CTC AGC AAA AGT TC | ACT CGC CTG AGA AAA CAG GGG TAA ATT CCC CGA ATG GCG GCG CTA TTA TTA GAA AAA CTC ATC GAG CAT CAA ATG |
| KanDeletion-seg19 | AAG ATA ACT AAA GCA CTG GCT TGA TAA ATA ACC GAA TGG CGG CAA CTG ATC CTT CAA CTC AGC AAA AGT TC | AGA AAA ATA ACC CGA TAA TGG TAG ATC TCC CTC TTT ATC CTG AAA TTA TTA GAA AAA CTC ATC GAG CAT CAA ATG |
| KanDeletion-seg20 | CAG TCT TAT GAA TAT CGC AAT CGG CGA ATA CCT CTG GTC GTA GAG CTG ATC CTT CAA CTC AGC AAA AGT TC | TTT TGC AGT AAA AAA TTG TCC ACG GAG GTG TGG AGA AAA AAC AAG TTA TTA GAA AAA CTC ATC GAG CAT CAA ATG |

TABLE 3-continued

Primers used for PCR of kanamycin cassette for chromosomal deletion. Forward primers disclosed as SEQ ID NOS 1-87, respectively, in order of appearance, and reverse primers discolsed as SEQ ID NOS 88-174, respectively, in order of appearrance.

| Casserte | Forward primer | Reverse primer |
|---|---|---|
| KanDeletion-seg21 | ATA TAA AAA ATA TTT CGG TGT AGT CCT TTC GTC ATG TAA AAC GTT CTG ATC CTT CAA CTC AGC AAA AGT TC | AAA TCG TTT TGC TGC CGT ATA TAT CGC CAT TAT TCC CAT TTC TGC TTA TTA GAA AAA CTC ATC GAG CAT CAA ATG |
| KanDeletion-seg22 | TGT CAT GTA AAC CAA ACA GAG AAT GTC TTT TCA GCG CAT CGC AGC TG ATC CTT CAA CTC AGC AAA AGT TC | ACG TGA TCT GTT CGG TCG CTA ATC CAT TCG GCG CTC CTG CGG GAG TTA TTA GAA AAA CTC ATC GAG CAT CAA ATG |
| KanDeletion-seg23 | CTG ATT TAC TGA GGG TCA AAT AAA TAT AGC GGC AGG AAA AAA GCG CTG ATC CTT CAA CTC AGC AAA AGT TC | TAC AGT GAC TTC ATA AAA ATT ATG AGA TTT TTC ACG GTG CTG TAA TTA TTA GAA AAA CTC ATC GAG CAT CAA ATG |
| KanDeletion-seg24 | ATT TGC CGT GTG GTT AGT CGC TTT ACA TCG GTA AGG GTA GGG ATT CTG ATC CTT CAA CTC AGC AAA AGT TC | TTT TTT GCG CCG ACA TCA TAA CGG TTC TGG CAA ATA TTC TGA AAT TTA TTA GAA AAA CTC ATC GAG CAT CAA ATG |
| KanDeletion-seg25 | CTT GCG TAC TAG TTA ACT AGT TCG ATG ATT AAT TGT CAA CAG CTC CTG ATC CTT CAA CTC AGC AAA AGT TC | GCT GAA CTG TTA ATA CAA TTT GCG TGC CAA TTT TTT ATC TTT TTG TTA TTA GAA AAA CTC ATC GAG CAT CAA ATG |
| KanDeletion-seg26 | ATC CTG GCA TGT TGC TGT TGA TTC TTC AAT CAG ATC TTT ATA AAT CTG ATC CTT CAA CTC AGC AAA AGT TC | AAT CGC TGA CAG AAA CCG ATA TTG ACA TCC TCC ACG CCC TGA AGG TTA TTA GAA AAA CTC ATC GAG CAT CAA ATG |
| KanDeletion-seg27 | CCG AAA TGA TTC AGG CGA CAG CCT GAA CGT AGC AGG GAT CCA CGT CTG ATC CTT CAA CTC AGC AAA AGT TC | ACC ATT GCC TGC GCA ATG GTG TTT TTG TTT TTA TCT GCT TTA TAC TTA TTA GAA AAA CTC ATC GAG CAT CAA ATG |
| KanDeletion-seg28 | GGG GCT TTT ATC GTC TTT GCT TTA CCG CCA GGG CGT CGG CCT CAA CTG ATC CTT CAA CTC AGC AAA AGT TC | TCC AGC AAA AAT TCT TCC CGA TCG TCA TTA CCA GCT GAC GTG ATA TTA TTA GAA AAA CTC ATC GAG CAT CAA ATG |
| KanDeletion-seg29 | TGG CAT TTC CGC GTC TGT TTA TTG TTG CCC GGC GTA TGG AGT AAA CTG ATC CTT CAA CTC AGC AAA AGT TC | AAT GTT AAG TAG TGA TTC GTG CCG GGG CGA TGT CTC GTT TTA CCC TTA TTA GAA AAA CTC ATC GAG CAT CAA ATG |
| KanDeletion-seg30 | CAC CTT AGA ACG CCG GAT AAA GAC TGA TAA TTG TCT TCG ACG GTC CTG ATC CTT CAA CTC AGC AAA AGT TC | CTG GGC GGT GGC GGT GAA CGC TAT GCC TGT GGT GTA ATT AAG TAA TTA TTA GAA AAA CTC ATC GAG CAT CAA ATG |
| KanDeletion-seg31 | TCG CAA CTT GAG CAA GCA CCA CCG CAA GGT ACG CTG GCC TCT TAA CTG ATC CTT CAA CTC AGC AAA AGT TC | AAC AAC TCA GGC AAC ACG CAA ACG ATT TAC TCG TCG TAT TTC AAG TTA TTA GAA AAA CTC ATC GAG CAT CAA ATG |
| KanDeletion-seg32 | ATA GTA AGT GAC TGG GGT GAA CGA ACG TAG CCG CAG CAC ATG CAA CTG ATC CTT CAA CTC AGC AAA AGT TC | TGC CTT TGA CGA TCT ATT GCT ATA AAT AAG TGA TCT TTT TTC TTT TTA TTA GAA AAA CTC ATC GAG CAT CAA ATG |
| KanDeletion-seg33 | ATC ATG ATT AGC AAA ACT TAA CCA TTT TAA AAT AAA TAA ACA ATT CTG ATC CTT CAA CTC AGC AAA AGT TC | TGA ACT TAA GTC TCA GAC CTA TTT TTC CGG TAA TCC CTC TCG AAT TTA TTA GAA AAA CTC ATC GAG CAT CAA ATG |
| KanDeletion-seg34 | TGG GTC TGT TAC AGG TTG ATG GAA GGC GGG GCG CAA AAA GAG CAA CTG ATC CTT CAA CTC AGC AAA AGT TC | CTT TGG GGA TTG ACT TCT CTT TAG GGT AAT TAA TAG CCG TTA ACT TTA GAA AAA CTC ATC GAG CAT CAA ATG |
| KanDeletion-seg35 | ATG CAA TGA ATA AAA AGT TAT ATC ACT TTT TCT CAT AAA ACA GTC CTG ATC CTT CAA CTC AGC AAA AGT TC | CGT ACA GCG CGC TTA CCA TAC AAA CTC CCT TTA AAA TGG CCG ATG TTA TTA GAA AAA CTC ATC GAG CAT CAA ATG |
| KanDeletion-seg36 | GCA ATC TTC TCT TTT CTG AAT TTG CCA CCT ATC ATA GAC AGG TGC CTG ATC CTT CAA CTC AGC AAA AGT TC | AGC AAT GGC GTG AGC ACA GGT ATC TTT CTC TGT TGG CCG TAT TGT TTA TTA GAA AAA CTC ATC GAG CAT CAA ATG |
| KanDeletion-seg37 | TAA TAA GCT AAC CCG CAT TGA GTT AAC CAA TAA CGG ATT CCA TAC CTG ATC CTT CAA CTC AGC AAA AGT TC | ATA ACC TCA CAT TAT CCC TGA ATT AAA AGT GGT AAT AAT AAA ACA TTA TTA GAA AAA CTC ATC GAG CAT CAA ATG |
| KanDeletion-seg38 | ACA ATA TTT AAT ATA GTG TCT CCA CAT GCG ATA TTT CTT AAA TAA CTG ATC CTT CAA CTC AGC AAA AGT TC | GTG AAA AGG GGT TAG ATA GTA CCA AAT GGG AAA ATG TTA AGT AAG TTA TTA GAA AAA CTC ATC GAG CAT CAA ATG |

TABLE 3-continued

Primers used for PCR of kanamycin cassette for chromosomal deletion. Forward primers disclosed as SEQ ID NOS 1-87, respectively, in order of appearance, and reverse primers discolsed as SEQ ID NOS 88-174, respectively, in order of appearrance.

| Casserte | Forward primer | Reverse primer |
| --- | --- | --- |
| KanDeletion-seg39 | GAT AAA CCA TCA GCT GAT AGT TTA CCT GAA GAA TAT AGA GAA GTA CTG ATC CTT CAA CTC AGC AAA AGT TC | AAT CAC TTT TGC CGA GGT AAC AGC GTC ATA ACA ACA ATT AAA GCC TTA TTA GAA AAA CTC ATC GAG CAT CAA ATG |
| KanDeletion-seg40 | CTT TTT AAA ATT CGT TCT TCC ATG CCC GGT AAC GCT CCA GAA AAC CTG ATC CTT CAA CTC AGC AAA AGT TC | GGG TAT GGA GCT ATG GGT ATT TTC TGT ACC CAA TGC TTT TAA CAG TTA TTA GAA AAA CTC ATC GAG CAT CAA ATG |
| KanDeletion-seg41 | AGA ACC AGA TTG ATG CAT TGA GCT TTC ATC CTA TGA AAT TAA TTG CTG ATC CTT CAA CTC AGC AAA AGT TC | TCT CCC TTG TTT GAA TTG AAA AGT CCA GGC TGC AAA GTC TGG GCT TTA TTA GAA AAA CTC ATC GAG CAT CAA ATG |
| KanDeletion-seg42 | TTT TTA CGG GCA CAG CCA AAC TTT ACC GTG CCC TAA TAC GAC AAA CTG ATC CTT CAA CTC AGC AAA AGT TC | GAG GTA ATT CAG GCG TAA TCA ACA ACC CTT GTC TAT AGT TAG TGA TTA TTA GAA AAA CTC ATC GAG CAT CAA ATG |
| KanDeletion-seg43 | ACC AAA CTG ATT AGA CAT TCT CGT TCT CCA TTT GCG TAA AAC CTG CTG ATC CTT CAA CTC AGC AAA AGT TC | TTC AAC CGC TAT ACC TGC TAT CTT CAA CTT CAG GAC AAT AAT GCA TTA TTA GAA AAA CTC ATC GAG CAT CAA ATG |
| KanDeletion-seg44 | TGA CGA CAA CAG TAA CAT TCA ACG TTA AAT ATG TTA ATA AGA CGT CTG ATC CTT CAA CTC AGC AAA AGT TC | AAA ATC AGG GAT TGT ACC GAT GAT TTA TAG TTT CAA GTT GGC ACT TTA TTA GAA AAA CTC ATC GAG CAT CAA ATG |
| KanDeletion-seg45 | TTG CAA TAC AAT TCT TC GCC TGT AGG ATT AGT AAG AAG ACT TAT CTG ATC CTT CAA CTC AGC AAA AGT TC | TTG CCG CCG CTG GCG GAA GCA TAA AAA AAT GGC GCC GAT GGG CGC TTA TTA GAA AAA CTC ATC GAG CAT CAA ATG |
| KanDeletion-seg46 | CCG GTT ATC CGC ATC AAG AAG TAA TTC TTG CCG CAG TGA AAA ATG CTG ATC CTT CAA CTC AGC AAA AGT TC | CTT GAC TTG CTT CAC TGT AGC GGC AAG GTA CGA GCC AAT CGT GGA TTA TTA GAA AAA CTC ATC GAG CAT CAA ATG |
| KanDeletion-seg47 | TTC AGT ATA AAA GGG CAT GAT AAT TTA CAT TAA CTC CTT TTT TTC CTG ATC CTT CAA CTC AGC AAA AGT TC | AGT CGA TAG TAA CCC GCC CTT CGG GGA TAG CAA GCA TTT TTT GCA TTA TTA GAA AAA CTC ATC GAG CAT CAA ATG |
| KanDeletion-seg48 | GCC GCG GCA TTA TAC AGA GCG TAA CCG ATT GCA TCT ACC CCT TTT CTG ATC CTT CAA CTC AGC AAA AGT TC | CTA TTA ACT GTA ATA TTT GAG CGG CAC GCG CTG CCG CTC ATC ACA TTA TTA GAA AAA CTC ATC GAG CAT CAA ATG |
| KanDeletion-seg49 | CCT CCT GTA GGG TTT TTA TTA ACA ACG GCT TAT TCT AAT TAT TTT CTG ATC CTT CAA CTC AGC AAA AGT TC | GCT GCA TCC AGA AAG TAA CAA TAG CGA ACA GAC AAA AAG AAT ACG TTA TTA GAA AAA CTC ATC GAG CAT CAA ATG |
| KanDeletion-seg50 | CAA CCC CGT CCT GTA CGG GGT TTG TTT TTT GGA GGC CAC GTT TTG CTG ATC CTT CAA CTC AGC AAA AGT TC | CAA ATC GCC GGA ATT TCC CGT GAT ATA AGG GCT GAG AGC AAA TCG TTA TTA GAA AAA CTC ATC GAG CAT CAA ATG |
| KanDeletion-seg51 | TTC AGG CGT TTT TTG CTA TC TTT GAC AAA AAA TAT CAA CTT TCT CTG ATC CTT CAA CTC AGC AAA AGT TC | GCG GTG AAT AAT GTC GAT GAT GTC GAA ATG ACA CGT CGA CAC GGC TTA TTA GAA AAA CTC ATC GAG CAT CAA ATG |
| KanDeletion-seg52 | TTT ATT GTT ATT AAA GAG ATT TTT AAG CTA AAG ATG AAT TTC GTC CTG ATC CTT CAA CTC AGC AAA AGT TC | ACG GTT CTG GCC TGG GGA CTT GTA GGC CTG ATA AGA GCG GTC AAG TTA TTA GAA AAA CTC ATC GAG CAT CAA ATG |
| KanDeletion-seg53 | TTG TAG GCC GCA CGC CAC ATC CGA CAT TCA GCG CCT GAT GCG ACG CTG ATC CTT CAA CTC AGC AAA AGT TC | GAA CAA GAA AAA TTC CGC TTT CGT TAT GAA CAA TAA TTT ACG TAG TTA TTA GAA AAA CTC ATC GAG CAT CAA ATG |
| KanDeletion-seg54 | AAT GGC GGC GAA AAT CAG CAT AAA ACG GCT GGT CAT GGT CGT ACC CTG ATC CTT CAA CTC AGC AAA AGT TC | TAT CTA CCC CTC TAT TGG TGG GTT AGT GGT TGC AAA CCT TAC GTG TTA TTA GAA AAA CTC ATC GAG CAT CAA ATG |
| KanDeletion-seg55 | ATC ACA AAG GAA ATA TGC CTG AGC AGC AGT CAG AGA CAT AAC TGG CTG ATC CTT CAA CTC AGC AAA AGT TC | CTC GAT TCT GCT GTG GCT TTT GCG GCT AGT GTA TCA GAA TCG CTT TTA GAA AAA CTC ATC GAG CAT CAA ATG |
| KanDeletion-seg56 | TAT GGT CAC TCA TTT GAT CCA TTA TGC CTT ATT GTG CCG TGA CTA CTG ATC CTT CAA CTC AGC AAA AGT TC | CGA TAG TCG TTA ACT GTT TTA CAC TTA ATA AAA TAA TTT GAG GTT TTA TTA GAA AAA CTC ATC GAG CAT CAA ATG |

TABLE 3-continued

Primers used for PCR of kanamycin cassette for chromosomal deletion. Forward
primers disclosed as SEQ ID NOS 1-87, respectively, in order of appearance, and
reverse primers discolsed as SEQ ID NOS 88-174, respectively, in order of appearrance.

| Casserte | Forward primer | Reverse primer |
| --- | --- | --- |
| KanDeletion-seg57 | CCC GCT GAC GAA GGC AAA CCC ATA GAC ATG TCG TCA GAC ATA GCG CTG ATC CTT CAA CTC AGC AAA AGT TC | AGA GCT TCC GGC TCT GCA TGA TGA TGT CCT TAT ATT TGG CAT TCC TTA TTA GAA AAA CTC ATC GAG CAT CAA ATG |
| KanDeletion-seg58 | ATT TAT TCC CCT CGC GTC CCG CCC GTT GTT ACT CTT CCT TGT TGA CTG ATC CTT CAA CTC AGC AAA AGT TC | TTA CTG CAA TTG CTG CTG CTT TGT AAA GCA CCG CGG CCT TTT TTG TTA TTA GAA AAA CTC ATC GAG CAT CAA ATG |
| KanDeletion-seg59 | GGA GAA AGC CTC GTG TAT ACT CCT CAC CCT TAT AAA AGT CCC TTT CTG ATC CTT CAA CTC AGC AAA AGT TC | GAT TAT GGC GAG CAA GGC CAG ATA AAC GCC AGG TTT TGG GGA TCG TTA TTA GAA AAA CTC ATC GAG CAT CAA ATG |
| KanDeletion-seg60 | AAC AAC CCG TAG GCC GGA CAA GAT GCG CCA GCA TCG CAT CCG GCA CTG ATC CTT CAA CTC AGC AAA AGT TC | TAA AGA AAC CAG GGT GTC ATC GTC TGC GTC GCA TGT TAA GGT CAG TTA TTA GAA AAA CTC ATC GAG CAT CAA ATG |
| KanDeletion-seg61 | ATG GCG ATG AGT GTT TCC ATT GCT GTT CTC TTT TAT ACT GTG GGC CTG ATC CTT CAA CTC AGC AAA AGT TC | AAA CAA TGC CTC TTA AGG TTT TCT TAA GGT TCT TCT GAA AGT GAA TTA TTA GAA AAA CTC ATC GAG CAT CAA ATG |
| KanDeletion-seg62 | CTG AAA TGG TTC TCA ATC AAC GTC ATT TGT ACA TTT TGT GCG CTT CTG ATC CTT CAA CTC AGC AAA AGT TC | TGC TGA TGC GCA AAG TCC GTC AGC AGT TTG CAG TGC AAT AAA GGT TTA TTA GAA AAA CTC ATC GAG CAT CAA ATG |
| KanDeletion-seg63 | TGA CGA CGC GGA GAA CCG GAA GCT AAA TAC AGA GAA GTC ATA GAA CTG ATC CTT CAA CTC AGC AAA AGT TC | GGG TTG AGC TGG CTA GAT TAG CCA GCC AAT CTT TTG TAT GTC TGT TTA TTA GAA AAA CTC ATC GAG CAT CAA ATG |
| KanDeletion-seg64 | TTC CAT GCT GAA AAG CCC GTT TTC AGG ATA CTC AAA TGG AAA CGC CTG ATC CTT CAA CTC AGC AAA AGT TC | ACT GAA CGG TCC CCT CGC CCC TTT GGG GAG AGG GTT AGG GTG AGG TTA TTA GAA AAA CTC ATC GAG CAT CAA ATG |
| KanDeletion-seg65 | CAT CCG GCG ATG CTG GCG CGT TGA ATT TTA CAT CCC GTA CGT TCC CTG ATC CTT CAA CTC AGC AAA AGT TC | ATC TAA AAA GAT GAT CTT AAT AAA TCT ATT AAG AAT GAG ATG GAG TTA TTA GAA AAA CTC ATC GAG CAT CAA ATG |
| KanDeletion-seg66 | TAA GTA AAG GAG TGA AAC AGT TTC ATA AGT AAA ATA TCC AGT GTG CTG ATC CTT CAA CTC AGC AAA AGT TC | GCT ATA AAG GAA CGC GCT TTG TCA GCT TTG TAG GCG AAC AAT AAG TTA TTA GAA AAA CTC ATC GAG CAT CAA ATG |
| KanDeletion-seg67 | TTG AAC TGC TGG CCT GGC AGA AGA AAT TTA AAG TTA AAA AAT AAC CTG ATC CTT CAA CTC AGC AAA AGT TC | GAC TCG GCA TGT TTG GGA TTA TTA AGC TGA CAA TTC ATA CGA TTA TTA GAA AAA CTC ATC GAG CAT CAA ATG |
| KanDeletion-seg68 | CAT TCG TCA TCA ATT TGA ACA ACA CAA TAC TGA CCC ACA TTC CCG CTG ATC CTT CAA CTC AGC AAA AGT TC | GTA ACG CTA AAG TCT CTT TTC AAA CTT GCA TTT TTG TAA ATT TGT TTA TTA GAA AAA CTC ATC GAG CAT CAA ATG |
| KanDeletion-seg69 | ACC ACA GCA AAG GGA AAA AGT GTG GGG AAA GAG TGT GCA TGA AGC CTG ATC CTT CAA CTC AGC AAA AGT TC | TTT TTC AAC TAT CTC TGT AAC CCT TGC CCG TAA ATT CGT GAT AGC TTA TTA GAA AAA CTC ATC GAG CAT CAA ATG |
| KanDeletion-seg70 | ACG TGA CTG GCG AAA TCT TCG CCA GTC GGT AAC AGC TTT ACG ACA CTG ATC CTT CAA CTC AGC AAA AGT TC | TTT ATT GTC GGC AGT GCC AGA AGT AAT TCA TGC GCG CCG GAT GGC TTA TTA GAA AAA CTC ATC GAG CAT CAA ATG |
| KanDeletion-seg71 | AGG CGC TGA TGG CGA AGT TAG CGT AGC GTT TAT GCC GGA TGG TAT CTG ATC CTT CAA CTC AGC AAA AGT TC | AGC ATC GTT CTC CCA TGG AGC TGA TGA CGA TGC TGC GGT GAC GTG TTA TTA GAA AAA CTC ATC GAG CAT CAA ATG |
| KanDeletion-seg72 | CCG CTG GCG ACG CGG ATG TCG CAT CAG GGG CAG CCC GTT TAA GCG CTG ATC CTT CAA CTC AGC AAA AGT TC | AAG CAC CTT AAT TAT CGT CGC ATT CAG AAC AGT CTG GAT GCG ATG TTA TTA GAA AAA CTC ATC GAG CAT CAA ATG |
| KanDeletion-seg73 | CGT CTA AAC ATA ATA TCC CTT TAT GGT GCA AAG AAA GAA TTA ACG CTG ATC CTT CAA CTC AGC AAA AGT TC | ATT CTT TGA CCG AGC TAG TTA TGG CGC GGA GTA TTA GTT ACG CTT TTA GAA AAA CTC ATC GAG CAT CAA ATG |
| KanDeletion-seg74 | AAT TAT TTG TCG TTA TGA TTT AAA TGT TTT GTT TTA CAC TCT GTC CTG ATC CTT CAA CTC AGC AAA AGT TC | GGG TGA AAC AGT CAG TTT CCG CTA AGA TTG CAT GCC GGA TAA GCC TTA TTA GAA AAA CTC ATC GAG CAT CAA ATG |

TABLE 3-continued

Primers used for PCR of kanamycin cassette for chromosomal deletion. Forward primers disclosed as SEQ ID NOS 1-87, respectively, in order of appearance, and reverse primers discolsed as SEQ ID NOS 88-174, respectively, in order of appearrance.

| Casserte | Forward primer | Reverse primer |
| --- | --- | --- |
| KanDeletion-seg75 | CGC TAT TAC AGC AAT ATT TTT CGT GAT GAA CGT GCC GGA AAG CGA CTG ATC CTT CAA CTC AGC AAA AGT TC | TAC ATT TCA TAG TGA TGC TCC TTA CTC TTG AGA CAG ACA CGT TAG TTA TTA GAA AAA CTC ATC GAG CAT CAA ATG |
| KanDeletion-seg76 | ATC AGA TTC ACC GAT ATC GCC TCT TTT ATT GTG GGA TTG ACC CTG CTG ATC CTT CAA CTC AGC AAA AGT TC | GTG AAC ATA ATA AAT GAA AAA AGA AAA CGC CAC TAC ACG CAT TTT TTA TTA GAA AAA CTC ATC GAG CAT CAA ATG |
| KanDeletion-seg77 | GCA GGA CTT ATT CAT TTC GTG AAT TTT ATT ATT TTA TTT ATA AAC CTG ATC CTT CAA CTC AGC AAA AGT TC | AAA TCA GGG AAG ATG AAA AAA CTT CAG GAT GGT AAG AAA AAG AAA TTA TTA GAA AAA CTC ATC GAG CAT CAA ATG |
| KanDeletion-seg78 | ATG GTT AGT TTA TAT TTG CAG TCC GGT TTG CTT TGC ATA CCG GAT CTG ATC CTT CAA CTC AGC AAA AGT TC | CGT ATT AGC TTT TCG GAT TAT ACG CCC TCA ACA GAG CCT GTC TCA TTA TTA GAA AAA CTC ATC GAG CAT CAA ATG |
| KanDeletion-seg79 | ACC AGA ACC TGG CTC ATC AGT GAT TTT CTT TGT CAT AAT CAT TGC CTG ATC CTT CAA CTC AGC AAA AGT TC | CAC TTT TAT TAA CTC AGC ATT ATT TTT AAA CAT CAA ACC ACT TAA TTA TTA GAA AAA CTC ATC GAG CAT CAA ATG |
| KanDeletion-seg80 | CCG TAA AAG TTT CGG TGG AAT GAG ATC TTG CGA TTT TGT TAA TAA CTG ATC CTT CAA CTC AGC AAA AGT TC | AGA AAC ACA GTT AAA AAT TGC AAA AGA TTT TTT AGA CCT GGA GAA TTA TTA GAA AAA CTC ATC GAG CAT CAA ATG |
| KanDeletion-seg81 | AAT AAA TGC GTG AAA AAC TTT ACT TGC AAT AGA ACT TGA TAC TTC CTG ATC CTT CAA CTC AGC AAA AGT TC | CAC CCT AAC CCT CTC CCC AGA GGG GCG AGG GGA CCG ATT GTG CTC TTA TTA GAA AAA CTC ATC GAG CAT CAA ATG |
| KanDeletion-seg82 | CAC CCC AAT GGG GAG AGG GAG AAA ACG AGC GCA ATA TTC AAT ATC CTG ATC CTT CAA CTC AGC AAA AGT TC | CAT TGT AAA CAT TAA ATG TTT ATC TTT TCA TGA TAT CAA CTT GCG TTA TTA GAA AAA CTC ATC GAG CAT CAA ATG |
| KanDeletion-seg83 | TTT CTG TAA GTG AGA ACT TGA GGT TTT TTA TTA ACA CAT CAG GAT CTG ATC CTT CAA CTC AGC AAA AGT TC | AAT CAC CGT TTG CTT AAA AAT GGA TTC TAC CAT CGC TTT TTC AGA TTA TTA GAA AAA CTC ATC GAG CAT CAA ATG |
| KanDeletion-seg84 | AAC AGA CTG ATC GAG GTC ATT TTT GAG TGC AAA AAG TGC TGT AAC CTG ATC CTT CAA CTC AGC AAA AGT TC | AAT AAG TTC TTC TGG CGT AAT AAC CCT GAA CGC CGG GCT TCG GTT TTA GAA AAA CTC ATC GAG CAT CAA ATG |
| KanDeletion-seg85 | GAA TAA GGT GTG TTT ATT TAT CGC GGG CAT AAA AAA ACC CTT ACT CTG ATC CTT CAA CTC AGC AAA AGT TC | TTT TTT TAT TTC TAC TGA TAA GAA TTA CAA GGC ACA TCA CGT TAT TTA TTA GAA AAA CTC ATC GAG CAT CAA ATG |
| KanDeletion-seg86 | GTG ATG AAG ATC ACG TGA GAA AAT TGT TAC ATT ACT ATG TTA CGC CTG ATC CTT CAA CTC AGC AAA AGT TC | ATC CAC ACA GAG ACA TAT TGC CCG TTG CAG TCA GAA TGA AAA GCT TTA TTA GAA AAA CTC ATC GAG CAT CAA ATG |

TABLE 4

MASC primers (SEQ ID NOS 175-2262, respectively, in order of appearance) used for analysis of recoded segments.

| Primer | Sequence |
| --- | --- |
| mAsPCR-seg00.1..Recoded | CAAGCTAGACGAAGGCATGTCA |
| mAsPCR-seg00.1..Reverse | CGATATTTTCCCGTGGTTCTGAC |
| mAsPCR-seg00.1..Wild-Type | CAAGTTAGACGAAGGCATGAGT |
| mAsPCR-seg00.2..Recoded | CGACCATGGCGATCTTGAGC |
| mAsPCR-seg00.2..Reverse | TTCCAGGTATTACGCAGAAATTGTTC |
| mAsPCR-seg00.2..Wild-Type | CGACCATGGCGATTTACAGT |
| mAsPCR-seg00.3..Recoded | CTTACCGCGCAAAATTTCATCTCA |
| mAsPCR-seg00.3..Reverse | TTTTTACGCAGCACTACTTGTATATGG |

TABLE 4-continued

MASC primers (SEQ ID NOS 175-2262, respectively, in order of appearance) used for analysis of recoded segments.

| Primer | Sequence |
| --- | --- |
| mAsPCR-seg00.3..Wild-Type | TTAACCGCGCAAAATTTCATCAGC |
| mAsPCR-seg00.4..Recoded | CCTGTTTTCACACTACCGTTCA |
| mAsPCR-seg00.4..Reverse | TTAATTTGCATAGACCGTTTTCAGAGT |
| mAsPCR-seg00.4..Wild-Type | CCTGTTTAGCCACTACCGTAGC |
| mAsPCR-seg00.5..Recoded | CGGGAAGTGATGTTTTATCTCAACC |
| mAsPCR-seg00.5..Reverse | ACTTTCGCAGTGGCTTGTG |
| mAsPCR-seg00.5..Wild-Type | CGGGAAGTGATGTTTTATCTCAACT |
| mAsPCR-seg00.6..Recoded | TGCCGTCAGGGAGATAATTTTAG |
| mAsPCR-seg00.6..Reverse | CCCTGACCAACGCCAAAG |
| mAsPCR-seg00.6..Wild-Type | TGCCGTCAGGGAGATAATTTTGC |
| mAsPCR-seg00.7..Recoded | CACCGATGAAAAACAGCCCAAG |
| mAsPCR-seg00.7..Reverse | CGTTTTGTAGCCCGCTCTG |
| mAsPCR-seg00.7..Wild-Type | CACCGATGAAAAACAGCCCCAA |
| mAsPCR-seg00.8..Recoded | CCCGAGTGTGTATTCAGGTTCAAT |
| mAsPCR-seg00.8..Reverse | CCTGGACTTCGGTTTCACG |
| mAsPCR-seg00.8..Wild-Type | CCCGAGTGTGTATTCAGGTTCAAA |
| mAsPCR-seg01.1..Recoded | CGTCTGGAAGAGCACAAAGACT |
| mAsPCR-seg01.1..Reverse | AAAAAGTTCAAAAATTCGCTGTGGAG |
| mAsPCR-seg01.1..Wild-Type | CGTCTGGAAGAGCACAAAGACA |
| mAsPCR-seg01.2..Recoded | TGGATCTCAGATACAGAATCAGAAC |
| mAsPCR-seg01.2..Reverse | AGCCACTGATGCTGAAGGG |
| mAsPCR-seg01.2..Wild-Type | TGGATCAGATACAGAAAGCGAAT |
| mAsPCR-seg01.3..Recoded | GGTGCAAGCGTAACCTGTAG |
| mAsPCR-seg01.3..Reverse | GACTATTTCTACGGCACCATTCCC |
| mAsPCR-seg01.3..Wild-type | GGTGCAAGCGTAACCTGCAA |
| mAsPCR-seg01.4..Recoded | CGACCGCGGGAAAGATAATGT |
| mAsPCR-seg01.4..Reverse | GGCTGGGTTGGCGTTTTAAA |
| mAsPCR-seg01.4..Wild-Type | CGACCGCGGGACAAATAATGA |
| mAsPCR-seg01.5..Recoded | GTGGTTGCGGGTTTGGTTAG |
| mAsPCR-seg01.5..Reverse | GCTGGTCCGAAGCCTACG |
| mAsPCR-seg01.5..Wild-Type | GTGGTTGCGGGTTTGGTCAA |
| mAsPCR-seg01.6..Recoded | CCAACCTCACGTGACAGAAATAG |
| mAsPCR-seg01.6..Reverse | GGATGACCGCAATTCTGAAAG |
| mAsPCR-seg01.6..Wild-Type | CCAACCTCACGACTCAGAAATAA |
| mAsPCR-seg01.7..Recoded | GCCCGCCAGGTTAAAAACT |
| mAsPCR-seg01.7..Reverse | CAAGAAAATTCAACATCATCGGTGTAAT |
| mAsPCR-seg01.7..Wild-Type | GCCCGCCAGGTTAAAAACA |
| mAsPCR-seg01.8..Recoded | TAGTAGTGGGATTGTAAGAACGCATC |

TABLE 4-continued

MASC primers (SEQ ID NOS 175-2262, respectively, in order of appearance) used for analysis of recoded segments.

| Primer | Sequence |
| --- | --- |
| mAsPCR-seg01.8..Reverse | TGGTTAAGCAAACGGAAGACATTC |
| mAsPCR-seg01.8..Wild-Type | TAGTAGTGGGATTGTAAGAACGCATA |
| mAsPCR-seg02.1..Recoded | GGAAGAACATGCCAACTTTATCTCA |
| mAsPCR-seg02.1..Reverse | CCACCGCGTTGTTCAGTTC |
| mAsPCR-seg02.1..Wild-Type | GGAAGAACATGCCAACTTTATCAGT |
| mAsPCR-seg02.2..Recoded | GCAGATCTGATTGTCGCCTTCA |
| mAsPCR-seg02.2..Reverse | TGTAGTTATGCTGCCCGGAAA |
| mAsPCR-seg02.2..Wild-Type | GCAGATCTGATTGTCGCCAGT |
| mAsPCR-seg02.3..Recoded | TGAAGAAGTACTTATTGAAAAATGGCTATCG |
| mAsPCR-seg02.3..Reverse | CAGCCTGACACTAGCACTGT |
| mAsPCR-seg02.3..Wild-Type | TGAAGAAGTATTGATTGAAAAATGGCTAAGT |
| mAsPCR-seg02.4..Recoded | TTTTATTCACGCGTTTATACATTTCCGAT |
| mAsPCR-seg02.4..Reverse | TGCGTACCGGTGAAGGAAAA |
| mAsPCR-seg02.4..Wild-Type | TTTTATTCACGCGTTTATACATTTCCGAG |
| mAsPCR-seg02.5..Recoded | GCAATGTATCTGCCAATTTTCCATC |
| mAsPCR-seg02.5..Reverse | CATGTCATCCGAGTCTGCGA |
| mAsPCR-seg02.5..Wild-Type | GCAATGTATCTGCCAATTTTCCATT |
| mAsPCR-seg02.6..Recoded | GGTGAGGGCAATAATCTTTACACG |
| mAsPCR-seg02.6..Reverse | TCTTGCGGGTGTGGTATATGC |
| mAsPCR-seg02.6..Wild-Type | GGTGAGGGCAATAATCTTTACACC |
| mAsPCR-seg02.7..Recoded | CAGCACGAAGATGGTCACTCA |
| mAsPCR-seg02.7..Reverse | GATACCTTCCTCAGCACCTTCC |
| mAsPCR-seg02.7..Wild-Type | CAGCACGAAGATGGTCACAGC |
| mAsPCR-seg02.8..Recoded | GCACATGGGTTTAAACGGTAG |
| mAsPCR-seg02.8..Reverse | AAACTTCGTTAATTCGCATGGTGATAA |
| mAsPCR-seg02.8..Wild-Type | GCACATGGGTTTAAACGGCAA |
| mAsPCR-seg03.1..Recoded | AGAGCCGAAAAGCACTGTTCG |
| mAsPCR-seg03.1..Reverse | GTTTTGGCAGCATTAGTTTCAGGA |
| mAsPCR-seg03.1..Wild-Type | GCTGCCGAATAACACTGTTCT |
| mAsPCR-seg03.2..Recoded | GGTGGTGCCTTTGTCGTTA |
| mAsPCR-seg03.2..Reverse | GGGACGATTTAAACCACAGATAAAGT |
| mAsPCR-seg03.2..Wild-Type | GGTGGTGCCTTTGTCGTTT |
| mAsPCR-seg03.3..Recoded | CAAAATCAAACAGAATATTGTGCTCTGA |
| mAsPCR-seg03.3..Revere | CTGGCCTATATCTCTGCACTGG |
| mAsPCR-seg03.3..Wild-Type | CAAAATCAAACAGAATATTGTGCTCACT |
| mAsPCR-seg03.4..Recoded | TAGCATGCGAGAGTCTGAGTAAAGT |
| mAsPCR-seg03.4..Reverse | ATTATCCCTCAGGCTTCTGTTCG |

TABLE 4-continued

MASC primers (SEQ ID NOS 175-2262, respectively, in order of appearance) used for analysis of recoded segments.

| Primer | Sequence |
| --- | --- |
| mAsPCR-seg03.4..Wild-Type | CAACATGCGGCTGTCACTGTATAAA |
| mAsPCR-seg03.5..Recoded | GGTTACGCAGTTCGAGTGA |
| mAsPCR-seg03.5..Reverse | GCCTCATTTTTCCCCCGAAC |
| mAsPCR-seg03.5..Wild-Type | GGTTACGCAGTTCGAGGCT |
| mAsPCR-seg03.6..Recoded | CGACTTATCTGACGGCCCTATC |
| mAsPCR-seg03.6..Reverse | CGGATGTAGCTGATCTTTCGGTA |
| mAsPCR-seg03.6..Wild-Type | CGACTTATCTGACGGCCTTAAG |
| mAsPCR-seg03.7..Recoded | GTGGAGGATAGTCGGAATATGATG |
| mAsPCR-seg03.7..Reverse | GCCGCTAAACAGTCCTCACT |
| mAsPCR-seg03.7..Wild-Type | GTGGAGGATAGTCGGAATAGCTGC |
| mAsPCR-seg03.8..Recoded | ACGGTCATTAAAGTTCAACTGTCA |
| mAsPCR-seg03.8..Reverse | TTACCAATCGCTACGGTGTAATCA |
| mAsPCR-seg03.8..Wild-Type | ACGGTCATTAAAGTTCAACTGAGC |
| mAsPCR-seg04.1..Recoded | TTTGTGCGTCGTGAACTGAAAG |
| mAsPCR-seg04.1..Reverse | CCGTCAACTGAGCTGATTTTCATC |
| mAsPCR-seg04.1..Wild-Type | TTTGTGCGTCGTGAACACTTAA |
| mAsPCR-seg04.2..Recoded | CGTACTTCAGCATCTTTACGGATATCT |
| mAsPCR-seg04.2..Reverse | TCTTTACCACCGACTCAGCAG |
| mAsPCR-seg04.2..Wild-Type | CGTACTTCAGCATCTTTTCTGATATCG |
| mAsPCR-seg04.3..Recoded | ACATCGACTCTACCCAAGTTTCA |
| mAsPCR-seg04.3..Reverse | TCAACCTGGTCCGGTGAAC |
| mAsPCR-seg04.3..Wild-Type | ACATCGACTCTACCCAGGTCAGT |
| mAsPCR-seg04.4..Recoded | GAAGAGATCAAAGAGAAAGCGCTATC |
| mAsPCR-seg04.4..Reverse | AAGTCCCAGTGCGCGTTT |
| mAsPCR-seg04.4..Wild-Type | GAAGAGATCAAAGAGAAAGCGTTGAG |
| mAsPCR-seg04.5..Recoded | CGGCACCGCATATCAAAAATCT |
| mAsPCR-seg04.5..Reverse | ACTGGCACTACATCGTTCATCAT |
| mAsPCR-seg04.5..Wild-Type | CGGCACCGCATATCAAAAAGC |
| mAsPCR-seg04.6..Recoded | GGCATTTACTTTATCACCGGGTTAG |
| mAsPCR-seg04.6..Reverse | CAGCTATCATCTGTGGGCGAA |
| mAsPCR-seg04.6..Wild-Type | GGCATTTACTTTATCACCGGGTCAA |
| mAsPCR-seg04.7..Recoded | GTAGTACTTTGGGATTTGAGGCAAG |
| mAsPCR-seg04.7..Reverse | TAACCTGCTCTCTTCGCGTAC |
| mAsPCR-seg04.7..Wild-Type | GCAATACTTTGGGATTGCTGGCTAA |
| mAsPCR-seg04.8..Recoded | CACCTCATGAAGTTGTCCATCTGA |
| mAsPCR-seg04.8..Reverse | GCCCGTCCGCTTTTTAACTC |
| mAsPCR-seg04.8..Wild-Type | CACCTCATGTAATTGTCCATCGCT |
| mAsPCR-seg05.1..Recoded | AAAGATCGTGCGGAAGAATGGA |

TABLE 4-continued

MASC primers (SEQ ID NOS 175-2262, respectively, in order of appearance) used for analysis of recoded segments.

| Primer | Sequence |
| --- | --- |
| mAsPCR-seg05.1..Reverse | CTTAAGCAGATGAAAACCATACATTTTAGTG |
| mAsPCR-seg05.1..Wild-Type | ACAAATCGTGCGGAAGAATACT |
| mAsPCR-seg05.2..Recoded | AAGACCTATAAAGCGATGGTAAAAGATCTA |
| mAsPCR-seg05.2..Reverse | GCCATATTATTTTTCCCTGCATTCAA |
| mAsPCR-seg05.2..Wild-Type | AAGACCTATAAAGCGATGGTAAAAGATTTG |
| mAsPCR-seg05.3..Recoded | GAGTTCCAGTTCGCTCAAATCGA |
| mAsPCR-seg05.3..Reverse | CCCAATGGCTGCTAACGC |
| mAsPCR-seg05.3..Wild-Type | GAGTTCCAGTTCTCTCAAATCGT |
| mAsPCR-seg05.4..Recoded | GCTCTGACTGAACCTTCACAG |
| mAsPCR-seg05.4..Reverse | CGTAGTGGGGATGCCAGATC |
| mAsPCR-seg05.4..Wild-Type | GCTCTGACTGAACCTTCACGC |
| mAsPCR-seg05.5..Recoded | CGGAAGAGGACTCACGCCTT |
| mAsPCR-seg05.5..Reverse | CATACAGCCAGACAATCGAAAAGAA |
| mAsPCR-seg05.5..Wild-Type | CGGAAGAGGACTCACGCTTA |
| mAsPCR-seg05.6..Recoded | TCTACATGTAATACGGTTGAAACGCTA |
| mAsPCR-seg05.6..Reverse | GAGTGTTGTGTGCCGTGTTC |
| mAsPCR-seg05.6..Wild-Type | AGCACATGTAATACGGTTGAAACGTTG |
| mAsPCR-seg05.7..Recoded | ATGCTCTATCGTCTACAGCAAGTT |
| mAsPCR-seg05.7..Reverse | GGTGGGTAGATGCTGAGTGATAAA |
| mAsPCR-seg05.7..Wild-Type | ATGCTCTATCGTTTACAGCAGGTC |
| mAsPCR-seg05.8..Recoded | GGTAATTTCAGAATATGGTGGACAAAAC |
| mAsPCR-seg05.8..Reverse | ATTCTCTTCGGTAAAAATTGAGTTCATTAAA |
| mAsPCR-seg05.8..Wild-Type | GGTAATTTCAGAATATGGTGGACAAAAT |
| mAsPCR-seg06.1..Recoded | AGCTGATTGTTTTTAACCGTATTAAGTATAG |
| mAsPCR-seg06.1..Reverse | CTGGGGGCCGATGAAGTT |
| mAsPCR-seg06.1..Wild-Type | AACTGATTGTTTTTAACCGTATTAAGTATGC |
| mAsPCR-seg06.2..Recoded | GATTGCAGTGAGTGGCTGA |
| mAsPCR-seg06.2..Reverse | TTACCGATCTAGCAGAAGAAGCC |
| mAsPCR-seg06.2..Wild-Type | GATTGCAGTGAGTGGCGCT |
| mAsPCR-seg06.3..Recoded | CGGAAAGGGGTACTAGCACTT |
| mAsPCR-seg06.3..Reverse | GGAACGACCGCTTTTAGTGC |
| mAsPCR-seg06.3..Wild-Type | CGGAAAGGGGTATTGGCATTG |
| mAsPCR-seg06.4..Recoded | CCGTCAAAAGCTGCGATTG |
| mAsPCR-seg06.4..Reverse | TGAGCCTGGCGATCTGTTC |
| mAsPCR-seg06.4..Wild-Type | CCGTCAAAAGCTGCGATGC |
| mAsPCR-seg06.5..Recoded | CGGCGGGATATAACATGACGA |
| mAsPCR-seg06.5..Reverse | GCACTAGGTCACCAGCAAATC |

TABLE 4-continued

MASC primers (SEQ ID NOS 175-2262, respectively, in order of appearance) used for analysis of recoded segments.

| Primer | Sequence |
| --- | --- |
| mAsPCR-seg06.5...Wild-Type | CGGCGGGATATAACATGAGCT |
| mAsPCR-seg06.6...Recoded | CCATTGGACGTTTCACCTCA |
| mAsPCR-seg06.6...Reverse | GCGTCCCTGCTCCAGAAG |
| mAsPCR-seg06.6...Wild-Type | CCATTGGACGTTTCACCAGC |
| mAsPCR-seg06.7...Recoded | GGCGTCATTAATTTCATCCAGTGA |
| mAsPCR-seg06.7...Reverse | CTGGGGTCAGTCGGTGATC |
| mAsPCR-seg06.7...Wild-Type | GGCGTCATTAATTTCATCCAGGCT |
| mAsPCR-seg06.8...Recoded | GCGTGGTTATCAGCTAGTGTCA |
| mAsPCR-seg06.8...Reverse | GTGACTGCGGGCTTATCGA |
| mAsPCR-seg06.8...Wild-Type | GCGTGGTTATCAGTTGGTGAGC |
| mAsPCR-seg07.1...Recoded | TGAGGCTCAGTTAGTGTCGTC |
| mAsPCR-seg07.1...Reverse | TCGATGTTCCTGTCCTGCTG |
| mAsPCR-seg07.1...Wild-Type | TGAGGCTCAGTCAATGTCGTT |
| mAsPCR-seg07.2...Recoded | GCTGCCGCTTTCGGATCTA |
| mAsPCR-seg07.2...Reverse | GCAAAGCGCCACCAGAAAT |
| mAsPCR-seg07.2...Wild-Type | GCTGGCGCTTTCGGATCTG |
| mAsPCR-seg07.3...Recoded | GCCCAGGACGGTAGGATATCA |
| mAsPCR-seg07.3...Reverse | GTCTGGGCTGGCCTGATG |
| mAsPCR-seg07.3...Wild-Type | GCCCAGGACGGTAAGATATCG |
| mAsPCR-seg07.4...Recoded | GCGTGACTCCTGGTACGATC |
| mAsPCR-seg07.4...Reverse | CCCTGGCAAGTCGAAAAGC |
| mAsPCR-seg07.4...Wild-Type | GCGTGACTCCTGGTACGATT |
| mAsPCR-seg07.5...Recoded | TCAGGAAATCAATGTGCAGAATCAAC |
| mAsPCR-seg07.5...Reverse | TTTCGTTTCACAGTTCTATCATTTACGTAA |
| mAsPCR-seg07.5...Wild-Type | TCAGGAAATCAATGTGCAGAATCAAT |
| mAsPCR-seg07.6...Recoded | CGCATCAGAAAACGGCAGA |
| mAsPCR-seg07.6...Reverse | CGGGTGACTGGATCTATGTGAC |
| mAsPCR-seg07.6...Wild-Type | CGCATCAGAAAACGGCAGC |
| mAsPCR-seg07.7...Recoded | ATAATTTCTTGCGGATGATGACGAAG |
| mAsPCR-seg07.7...Reverse | CATTATTCATGTGGCAAACGGTATCA |
| mAsPCR-seg07.7...Wild-Type | ATAATTTCTTGCGGATGATGACGTAA |
| mAsPCR-seg07.8...Recoded | TGTAATGTCTCATTCTACCGATCACTC |
| mAsPCR-seg07.8...Reverse | AGAACCTGTACCACTGCCATTG |
| mAsPCR-seg07.8...Wild-Type | TGTAATGAGTCATTCTACCGATCACAG |
| mAsPCR-seg08.1...Recoded | CATGTTGTCCATCAGTTCTTTGTTTTT |
| mAsPCR-seg08.1...Reverse | GACCGCGTAACCATCGACT |
| mAsPCR-seg08.1...Wild-Type | CATGTTGTCCATCAGTTCTTTGTTTTG |
| mAsPCR-seg08.2...Recoded | GTCCCTTGATTTTGTTGACACGT |

TABLE 4-continued

MASC primers (SEQ ID NOS 175-2262, respectively, in order of appearance) used for analysis of recoded segments.

| Primer | Sequence |
| --- | --- |
| mAsPCR-seg08.2...Reverse | AAGCTGAACAAAAAAATCCCACCA |
| mAsPCR-seg08.2...Wild-Type | GTCCCTTGATTTTGTTGACACGG |
| mAsPCR-seg08.3...Recoded | AGCATTAGAAGTCGCTGGTGAAG |
| mAsPCR-seg08.3...Reverse | GTTTTTGCTCAGAACGCCATGT |
| mAsPCR-seg08.3...Wild-Type | AGCATCAATAATCGCTGGTGTAA |
| mAsPCR-seg08.4...Recoded | TCATTAGTGACGCGGGAAATG |
| mAsPCR-seg08.4...Reverse | GATGCATGAAAATCGCGAGGAG |
| mAsPCR-seg08.4...Wild-Type | TCATTAGTGACGCGGGAAATC |
| mAsPCR-seg08.5...Recoded | CCTGAGCAATTTCATCGGATGA |
| mAsPCR-seg08.5...Reverse | CGGGTATCTTACTCATATCGCTATATTCA |
| mAsPCR-seg08.5...Wild-Type | CCTGAGCAATTTCATCGCTGCT |
| mAsPCR-seg08.6...Recoded | CAGACACAGGAACACGACAATTAG |
| mAsPCR-seg08.6...Reverse | GGCGTTCTCCTCTTCTCGT |
| mAsPCR-seg08.6...Wild-Type | CAGACACAGGAACACGACAATCAA |
| mAsPCR-seg08.7...Recoded | ATACAGACGCAGCTCATGATCTAG |
| mAsPCR-seg08.7...Reverse | GTTTGTTACCGAGCGTCTGATC |
| mAsPCR-seg08.7...Wild-Type | ATACAGACGCAGCTCATGATCCAA |
| mAsPCR-seg08.8...Recoded | TCCGCGATGTCACCTCAC |
| mAsPCR-seg08.8...Reverse | CAACGCCCAGACCCAGAG |
| mAsPCR-seg08.8...Wild-Type | TCCGCGATGTCACCAGCT |
| mAsPCR-seg09.1...Recoded | GATAAGACACACGGTTAGCATATTTACAA |
| mAsPCR-seg09.1...Reverse | GCTATCTCACCAGGCCACAT |
| mAsPCR-seg09.1...Wild-Type | GATAGCTCACACGGTTAGCATATTTACAC |
| mAsPCR-seg09.2...Recoded | TATGAATATCTGGAACCGCTCGATCTA |
| mAsPCR-seg09.2...Reverse | GAAGGAATAAGTACATCATTGCGGAT |
| mAsPCR-seg09.2...Wild-Type | TATGAATATCTGGAACCGCTCGATTTG |
| mAsPCR-seg09.3...Recoded | CCAGACACCGGCAATAATCAGA |
| mAsPCR-seg09.3...Reverse | CATGATGAACACGGAAGGTAATAACG |
| mAsPCR-seg09.3...Wild-Type | CCAGACACCGGCAATAATCAGC |
| mAsPCR-seg09.4...Recoded | CGCATTAAAGCAGATAAAAAGCACCATA |
| mAsPCR-seg09.4...Reverse | ATGAAATAACCTCAGCGCTGGA |
| mAsPCR-seg09.4...Wild-Type | CGCATTAAAGCAGATAAATAACACCATC |
| mAsPCR-seg09.5...Recoded | TGTTTTTCCGTACGACTCGCT |
| mAsPCR-seg09.5...Reverse | CGCCTCAGTTCCCGTGAC |
| mAsPCR-seg09.5...Wild-Type | TGTTTTTCCGTACGACTCGCA |
| mAsPCR-seg09.6...Recoded | CGTTTCTCTGCTAATCTTTCGATGCTT |
| mAsPCR-seg09.6...Reverse | CTGCTACGCCATCCCGAAA |

TABLE 4-continued

MASC primers (SEQ ID NOS 175-2262, respectively, in order of appearance) used for analysis of recoded segments.

| Primer | Sequence |
| --- | --- |
| mAsPCR-seg09.6..Wild-Type | CGTTTCTCTGCTAATTTATCGATGTTA |
| mAsPCR-seg09.7..Recoded | TGTGTTTCGATATAACCGTGGGA |
| mAsPCR-seg09.7..Reverse | GGCCGAAGACTCACAAATCTTTC |
| mAsPCR-seg09.7..Wild-Type | TGTGTTTCGATATAACCGTGGCT |
| mAsPCR-seg09.8..Recoded | CTCTCAGCAGACGAGAAATCA |
| mAsPCR-seg09.8..Reverse | AGGCAAACCAGACATTCTCGT |
| mAsPCR-seg09.8..Wild-Type | CTCAGTGCAGACGAGAAAAGC |
| mAsPCR-seg10.1..Recoded | GCCAAGTACAGCGGAAAGTTTT |
| mAsPCR-seg10.1..Reverse | CAACTTATGGCGTGCTGTCG |
| mAsPCR-seg10.1..Wild-Type | GCCCAATACAGCGGAAAGTTTA |
| mAsPCR-seg10.2..Recoded | TGTAATGATGAATGACTTTCTTTTACACCA |
| mAsPCR-seg10.2..Reverse | AATACATCCGCAATTCTCAAACCTG |
| mAsPCR-seg10.2..Wild-Type | TGTAATGATGAATGACTTTCTTTTACACCG |
| mAsPCR-seg10.3..Recoded | GTCAGTTTATCCACGCCTGA |
| mAsPCR-seg10.3..Reverse | ACGTCTACAAGGCTTCGATACC |
| mAsPCR-seg10.3..Wild-Type | GTCAGTTTATCCACGCCGCT |
| mAsPCR-seg10.4..Recoded | TGATGCTGAACCGCATTGTAAAG |
| mAsPCR-seg10.4..Reverse | TGAAGAACAACTCGATACAGCACT |
| mAsPCR-seg10.4..Wild-Type | TGATGCTGAACCGCATTGTACAA |
| mAsPCR-seg10.5..Recoded | GAAGGTGAAAAGGTGGTTTCCTC |
| mAsPCR-seg10.5..Reverse | GGTTAGCGGATAAGTCACCTGAT |
| mAsPCR-seg10.5..Wild-Type | GAAGGTGAAAAGGTGGTTTCCAG |
| mAsPCR-seg10.6..Recoded | CACCTGATTTACCGCTTTTGGAATT |
| mAsPCR-seg10.6..Reverse | CGAGTTCTGGTTTGCGCTTATTAA |
| mAsPCR-seg10.6..Wild-Type | CACCTGATTTACCGCTTTTGGAATG |
| mAsPCR-seg10.7..Recoded | CGACCATTACCCCTTTCGGA |
| mAsPCR-seg10.7..Reverse | TGAAAATGATGCTGGAAGATGCG |
| mAsPCR-seg10.7..Wild-Type | CGACCATTACCCCTTTCGGC |
| mAsPCR-seg10.8..Recoded | ATAGAAGCTCCAGTAGATCAATCTGATGAG |
| mAsPCR-seg10.8..Reverse | CACGGGAATAACTCATCTGGCA |
| mAsPCR-seg10.8..Wild-Type | TTAACAACTCCAGCAAATCAATCTGATGAC |
| mAsPCR-seg11.1..Recoded | GGCTCATAACTACGCCATGTCA |
| mAsPCR-seg11.1..Reverse | GCCCATCAGCTCATCTTCCA |
| mAsPCR-seg11.1..Wild-Type | GGCTCATAACTACGCCATGAGT |
| mAsPCR-seg11.2..Recoded | GCGTGTATTTTGCCATGAACTCA |
| mAsPCR-seg11.2..Reverse | TGCGGTCAGGGTACAAATCAG |
| mAsPCR-seg11.2..Wild-Type | GCGTGTATTTTGCCATGAACAGC |
| mAsPCR-seg11.3..Recoded | CATATTTGATTTTAGCGATGGTTTCAGAT |

TABLE 4-continued

MASC primers (SEQ ID NOS 175-2262, respectively, in order of appearance) used for analysis of recoded segments.

| Primer | Sequence |
| --- | --- |
| mAsPCR-seg11.3..Reverse | GCAACACCTCAGCCTGCA |
| mAsPCR-seg11.3..Wild-Type | CATATTTGATTTTAGCGATGGTTTCAGAG |
| mAsPCR-seg11.4..Recoded | CAATAATTGACTGTGCCGGATCT |
| mAsPCR-seg11.4..Reverse | CGCTGCGCTCAATAAAAAACAG |
| mAsPCR-seg11.4..Wild-Type | CAATAATTGACTGTGCCGGATCG |
| mAsPCR-seg11.5..Recoded | CCTCGAAGACTCCGTAGCAC |
| mAsPCR-seg11.5..Reverse | ATTTCCACTGCGCGGGTAA |
| mAsPCR-seg11.5..Wild-Type | CCTCGAAGACTCCGTAGCAT |
| mAsPCR-seg11.6..Recoded | TGACAGCTCCACTTACCCTACTA |
| mAsPCR-seg11.6..Reverse | CAGACACCGTTTCCATATCCGA |
| mAsPCR-seg11.6..Wild-Type | TGACAGCTCCATTAACCCTATTG |
| mAsPCR-seg11.7..Recoded | GCTCCACGACTACTGGAAAATATTC |
| mAsPCR-seg11.7..Reverse | TCAATAGGTTAATCAATGGGGTGAGTTA |
| mAsPCR-seg11.7..Wild-Type | GCTCCACGTTTACTGGAAAATATTT |
| mAsPCR-seg11.8..Recoded | CGAAGACATAAACGAAAAGTATCAGCATAAG |
| mAsPCR-seg11.8..Reverse | TACTGACTTTATCTTCGCGGTACTG |
| mAsPCR-seg11.8..Wild-Type | CGAAGACATAAACGAATAATATCAGCATTAA |
| mAsPCR-seg12.1..Recoded | CGTAACGTTCAACCATGACTTGT |
| mAsPCR-seg12.1..Reverse | GCCATCGCCGATAAACTGAC |
| mAsPCR-seg12.1..Wild-Type | CGTAACGTTCAACCATCACCTGC |
| mAsPCR-seg12.2..Recoded | GGGTAGGGTAATACGCATCATCC |
| mAsPCR-seg12.2..Reverse | TTTGCACTTTCCACTCCGATG |
| mAsPCR-seg12.2..Wild-Type | AGGTAGGGTAATACGCATCATCA |
| mAsPCR-seg12.3..Recoded | CATAACCTATCACCAGCACCGTA |
| mAsPCR-seg12.3..Reverse | TATTTCGCGTCTACTAGTGATGGTT |
| mAsPCR-seg12.3..Wild-Type | CATAACCTATCACCAGCACCGTT |
| mAsPCR-seg12.4..Recoded | CTTTAAGCGGGCCATCAATCTGA |
| mAsPCR-seg12.4..Reverse | GCTGGCCTTCTCTCCTTACG |
| mAsPCR-seg12.4..Wild-Type | CTTTTAACGGGCCATCAATCTGG |
| mAsPCR-seg12.5..Recoded | ATAATCAGGTCTGGATTCTTCTCTTTGAG |
| mAsPCR-seg12.5..Reverse | GATAACGCTCATACTGGTCACAAC |
| mAsPCR-seg12.5..Wild-Type | ATAATCAGGTCTGGATTCTTCTCTTTTAA |
| mAsPCR-seg12.6..Recoded | GACTGGTCCGGTATTTATGCCT |
| mAsPCR-seg12.6..Reverse | CCCTGTAGGTCGTCGAGAAAT |
| mAsPCR-seg12.6..Wild-Type | GACTGGTCCGGTATTTATGCCA |
| mAsPCR-seg12.7..Recoded | GCGATCAATCCAAATCTCACCT |
| mAsPCR-seg12.7..Reverse | TGACCAAGCAGGACAACAC |

TABLE 4-continued

MASC primers (SEQ ID NOS 175-2262, respectively, in order of appearance) used for analysis of recoded segments.

| Primer | Sequence |
| --- | --- |
| mAsPCR-seg12.7..Wild-Type | GCGATCAATCCAAATCTCACCG |
| mAsPCR-seg12.8..Recoded | CGTTTGTATAGATCTTCCGCCGAT |
| mAsPCR-seg12.8..Reverse | GAGCAAATTCTGTCACTTCTTCTAATGAA |
| mAsPCR-seg12.8..Wild-Type | CGTTTGTATAAATCTTCCGCACTG |
| mAsPCR-seg13.1..Recoded | GCTTCTTGCGGATTCATCGAT |
| mAsPCR-seg13.1..Reverse | CTCCACCTCACCGTTCTATCC |
| mAsPCR-seg13.1..Wild-Type | GCTTCTTGCGGATTCATGCTG |
| mAsPCR-seg13.2..Recoded | AAAAAAACGTCGGGCAATTCTCT |
| mAsPCR-seg13.2..Reverse | GCTACCCGCGCCTGATAAC |
| mAsPCR-seg13.2..Wild-Type | AAAAAAACGTCGGGCAATTCTCA |
| mAsPCR-seg13.3..Recoded | GGTGTGTGAAGGATTTGATGACTCT |
| mAsPCR-seg13.3..Reverse | TGTTTACAAAGCGAGGGGTGATA |
| mAsPCR-seg13.3..Wild-Type | GGTGTGTGAAGGATTTGATGACAGC |
| mAsPCR-seg13.4..Recoded | TGGAATACGTGGTCTGGTTTCTT |
| mAsPCR-seg13.4..Reverse | GGCGTCATTACCCACCAGT |
| mAsPCR-seg13.4..Wild-Type | TGGAATACGTGGTCTGGTTTTA |
| mAsPCR-seg13.5..Recoded | GGCATTCAGGTTAGTAGAGGAC |
| mAsPCR-seg13.5..Reverse | TTAACTGGCAAAAAAGGGTGACA |
| mAsPCR-seg13.5..Wild-Type | GGCATTCAGGTTAGTGCTGCTG |
| mAsPCR-seg13.6..Recoded | GCAGGAGTCCTCGTATGGTATC |
| mAsPCR-seg13.6..Reverse | CGTAGTCGGTTAGAACTTGCCA |
| mAsPCR-seg13.6..Wild-Type | GCAGGAGTCCTCGTATGGTAAG |
| mAsPCR-seg13.7..Recoded | TGCCGTTGTTGACCGTTCA |
| mAsPCR-seg13.7..Reverse | CCATGAAGATTTTGGTGAACTGCT |
| mAsPCR-seg13.7..Wild-Type | TGCCGTTGTTGACCGTAGT |
| mAsPCR-seg13.8..Recoded | GAATCCATTGAATTTTGATGAAAGACGT |
| mAsPCR-seg13.8..Reverse | GCCTATACCGCCTATTCTCTGG |
| mAsPCR-seg13.8..Wild-Type | GAATCCATTGAATTTACTGCTAAGACGC |
| mAsPCR-seg14.1..Recoded | CTGATGTCTAAGATTATCGCGACTCTA |
| mAsPCR-seg14.1..Reverse | TTGCGTGAAAACAAGAGAGGTG |
| mAsPCR-seg14.1..Wild-Type | CTGATGAGTAAGATTATCGCGACTTTG |
| mAsPCR-seg14.2..Recoded | CAGACGGTAAATTTATGGTAATGGTTTC |
| mAsPCR-seg14.2..Reverse | GTGACTTTGTAAGACGGGTTAGAAC |
| mAsPCR-seg14.2..Wild-Type | GCGACGGTAAATTTATGGTAATGGTCAG |
| mAsPCR-seg14.3..Recoded | GTCGAACTTATTGATCATCTTGATTCCC |
| mAsPCR-seg14.3..Reverse | GCTCTCGCAGTCGTTCAT |
| mAsPCR-seg14.3..Wild-Type | GTCCAACTTATTGATCATCTTGATAGTT |
| mAsPCR-seg14.4..Recoded | CATCTGGGATATCAAAAAGCATATCGGTTAT |

TABLE 4-continued

MASC primers (SEQ ID NOS 175-2262, respectively, in order of appearance) used for analysis of recoded segments.

| Primer | Sequence |
| --- | --- |
| mAsPCR-seg14.4..Reverse | CAAGACGATGGGTAATACAGGCA |
| mAsPCR-seg14.4..Wild-Type | CATCTGGGATATCAAAAAGCATATCGGTTAC |
| mAsPCR-seg14.5..Recoded | TACCAATGGCTCGTAAATGGCTA |
| mAsPCR-seg14.5..Reverse | TGCCGAGCAGTGTCTGAC |
| mAsPCR-seg14.5..Wild-Type | TACCAATGGCTCGTAAATGGTTG |
| mAsPCR-seg14.6..Recoded | AAATGTTCTTCGGCAATTATTTCGTTATTC |
| mAsPCR-seg14.6..Reverse | TGGAACATGCTGTAAATATTCTCGTC |
| mAsPCR-seg14.6..Wild-Type | AAATGTTCTTCGGCAATTATTTCGTTATTA |
| mAsPCR-seg14.7..Recoded | TCGCAGTAATCGAGGCTGA |
| mAsPCR-seg14.7..Reverse | GGTTTGGCTCTGGTCTGGTAG |
| mAsPCR-seg14.7..Wild-Type | TCGCAGTAATCGAGGCGCT |
| mAsPCR-seg14.8..Recoded | AGAGATCGAGGGCCGTTACT |
| mAsPCR-seg14.8..Reverse | CAGCCGCACACTATGAGC |
| mAsPCR-seg14.8..Wild-Type | AGAGATCTAAGGCCGTCACC |
| mAsPCR-seg15.1..Recoded | CGGTGTCGAAATGGAAGCACTC |
| mAsPCR-seg15.1..Reverse | CGATGCGCAGAGGTGACA |
| mAsPCR-seg15.1..Wild-Type | CGGTGTCGAAATGGAAGCATTA |
| mAsPCR-seg15.2..Recoded | TGTTTAGCCTCTGGACCGTAAG |
| mAsPCR-seg15.2..Reverse | CGGACTGCATGAGATTTTTACCC |
| mAsPCR-seg15.2..Wild-Type | TGTTTAGCCTCTGGACCGTAGC |
| mAsPCR-seg15.3..Recoded | CGAAAACGTCCGTGATTACTCA |
| mAsPCR-seg15.3..Reverse | GATGCCATCTTTATTGAGCTGTTCA |
| mAsPCR-seg15.3..Wild-Type | CGAAAACGTCCGTGATTACAGC |
| mAsPCR-seg15.4..Recoded | CAACCTGACGCCGCTACTT |
| mAsPCR-seg15.4..Reverse | GATTAGCATACACTTCACCTTCAGTAC |
| mAsPCR-seg15.4..Wild-Type | CAACCTGACGCCGTTGTTG |
| mAsPCR-seg15.5..Recoded | CCGTCTGAACCTTTATGCATGGA |
| mAsPCR-seg15.5..Reverse | CTGTTCCGCACTGATATCGAAAATG |
| mAsPCR-seg15.5..Wild-Type | CCGTCTGAACCTTTATGCATACT |
| mAsPCR-seg15.6..Recoded | CCATCACAAGCAGGCCAGA |
| mAsPCR-seg15.6..Reverse | CGCGGATAAAAAACTTGTTGTCG |
| mAsPCR-seg15.6..Wild-Type | CCATCACTAACAGGCCGCT |
| mAsPCR-seg15.7..Recoded | CAGCAAATATAAGACCGTTAACTGAT |
| mAsPCR-seg15.7..Reverse | CGTTTTGCTAAGGATGTCATCGTC |
| mAsPCR-seg15.7..Wild-Type | CAGCAAATATCAAACCGTTAACGCTG |
| mAsPCR-seg15.8..Recoded | CGAACTGCATGGTGACGTTAG |
| mAsPCR-seg15.8..Reverse | ATTCCAGCTCACAGTGAAATCAGA |

TABLE 4-continued

MASC primers (SEQ ID NOS 175-2262, respectively, in order of appearance) used for analysis of recoded segments.

| Primer | Sequence |
| --- | --- |
| mAsPCR-seg15.8..Wild-Type | CGAACTGCATGGTGACGTTAC |
| mAsPCR-seg16.1..Recoded | CGGTCACAGTCTGAATGCCT |
| mAsPCR-seg16.1..Reverse | GTGCGTCATACAGCAGATCCT |
| mAsPCR-seg16.1..Wild-Type | CGGTCACAGTCTGAATGCCG |
| mAsPCR-seg16.2..Recoded | GGTCCGCAATCTCTCTTTTTCA |
| mAsPCR-seg16.2..Reverse | CTGCCACCACGCCCATAT |
| mAsPCR-seg16.2..Wild-Type | GGTCCGCAATCTCTCTTTTAGT |
| mAsPCR-seg16.3..Recoded | GCAATAATCACGTTAGCAATGCCT |
| mAsPCR-seg16.3..Reverse | GTACAAGTAAGGATGCGACTATTTAACTG |
| mAsPCR-seg16.3..Wild-Type | GCAATAATCACGTTAGCAATGCCG |
| mAsPCR-seg16.4..Recoded | TCCGGTGGTGTACGGACAAG |
| mAsPCR-seg16.4..Reverse | ACTTTACTTCACCATCGGAGTCC |
| mAsPCR-seg16.4..Wild-Type | TCCGGTGGTGTTCTGACTAA |
| mAsPCR-seg16.5..Recoded | CTGGGAGGGATGTTTGTTCTA |
| mAsPCR-seg16.5..Reverse | CGCAAGCAGAAGGTTACCC |
| mAsPCR-seg16.5..Wild-Type | CTGGGAGGGATGTTTGTTTTG |
| mAsPCR-seg16.6..Recoded | GTTCGAGATGCTGGGGTCA |
| mAsPCR-seg16.6..Reverse | CGGAAAGCGTCAATCACTGA |
| mAsPCR-seg16.6..Wild-Type | GTTCGAGATGCTGGGGAGC |
| mAsPCR-seg16.7..Recoded | CTGCCATTTCTGATTGTCTTTAAAATATCA |
| mAsPCR-seg16.7..Reverse | GCCGATCAGTAGACAGCAAAATG |
| mAsPCR-seg16.7..Wild-Type | CTGCCATTTCTGATTGTCTTTAAAATAAGC |
| mAsPCR-seg16.8..Recoded | CAGGGACGGGATCAGTGA |
| mAsPCR-seg16.8..Reverse | TCTGCCGCAGAGAAAATCAATTT |
| mAsPCR-seg16.8..Wild-Type | CAGGGACGGGATCAGGCT |
| mAsPCR-seg17.1..Recoded | TGAGAGATCGACTTTATGGCATGAC |
| mAsPCR-seg17.1..Reverse | AATACCTGAAAGAAGCATGGGAATTTAC |
| mAsPCR-seg17.1..Wild-Type | GCTGAGATCGACTTTATGGCAACTG |
| mAsPCR-seg17.2..Recoded | GACAAACTCCTTACGCTGAAAG |
| mAsPCR-seg17.2..Reverse | GGTGATGATTTCTCTGCGGTTATC |
| mAsPCR-seg17.2..Wild-Type | GACAAACTCCTTACGCGCTCAA |
| mAsPCR-seg17.3..Recoded | AGAATTACCTGACCACCGTTCATT |
| mAsPCR-seg17.3..Reverse | CAAACCAGGAGCTGCACAATG |
| mAsPCR-seg17.3..Wild-Type | AGAATTACCTGACCACCGTTCATC |
| mAsPCR-seg17.4..Recoded | TATTGCACGCATTCCAGAGAAGTC |
| mAsPCR-seg17.4..Reverse | GGGTGCGCTTTCTCGATTTC |
| mAsPCR-seg17.4..Wild-Type | TATTGCACGCATTCCAGAGAAGAG |
| mAsPCR-seg17.5..Recoded | CATCTGCGCATTTACACCTTCT |

TABLE 4-continued

MASC primers (SEQ ID NOS 175-2262, respectively, in order of appearance) used for analysis of recoded segments.

| Primer | Sequence |
| --- | --- |
| mAsPCR-seg17.5..Reverse | GTCCGCGAAGATGAGTCAGAT |
| mAsPCR-seg17.5..Wild-Type | CATCTGCGCATTTACACCTTCA |
| mAsPCR-seg17.6..Recoded | ATACAGAGAGACAATAATAATGGTAGATTCT |
| mAsPCR-seg17.6..Reverse | GCGCCACGATTCAGAGTAATC |
| mAsPCR-seg17.6..Wild-Type | ATACAGAGAGACAATAATAATGGTAGATAGC |
| mAsPCR-seg17.7..Recoded | CCGATCGCTGTCGTTTTTACT |
| mAsPCR-seg17.7..Reverse | TTCGAGTGAAAATCTACCTATCTCTTT |
| mAsPCR-seg17.7..Wild-Type | CCGATCGCTGTCGTTTTTACC |
| mAsPCR-seg17.8..Recoded | CTGGCGGATCGTGCTTCTA |
| mAsPCR-seg17.8..Reverse | GCCATCCCCACGGTCATAT |
| mAsPCR-seg17.8..Wild-Type | CTGGCGGATCGTGCTTTTG |
| mAsPCR-seg18.1..Recoded | TCGTACCCTGGTTACCAAAAACT |
| mAsPCR-seg18.1..Reverse | CCAGGTCAACAGCCAGGT |
| mAsPCR-seg18.1..Wild-Type | TCGTACCCTGGTTACCAAAAACA |
| mAsPCR-seg18.2..Recoded | CCGCAAAAAAGTAGTTGGTTGATAGT |
| mAsPCR-seg18.2..Reverse | CCATCGGCACATCATCATAAAACG |
| mAsPCR-seg18.2..Wild-Type | CCGCAAAAAAGTAGTTGGTTGAGAGA |
| mAsPCR-seg18.3..Recoded | CTTAATGCCTATAAAGCAGCAACACTATCT |
| mAsPCR-seg18.3..Reverse | TGGGTTGAGATGCCACGTTT |
| mAsPCR-seg18.3..Wild-Type | TTAAATGCCTATAAAGCAGCAACATTAAGC |
| mAsPCR-seg18.4..Recoded | GCTGAATCTTATCCGCTGCTTCTA |
| mAsPCR-seg18.4..Reverse | GTTCAAGCTGAGCAACGTCAC |
| mAsPCR-seg18.4..Wild-Type | GCTGAATCTTATCCGCTGTTATTG |
| mAsPCR-seg18.5..Recoded | GTTTCATAGCCAACACGATCTGA |
| mAsPCR-seg18.5..Reverse | GGTGTCTACAGCGGAAGTAGG |
| mAsPCR-seg18.5..Wild-Type | GTTTCATAGCCAACACGATCGCT |
| mAsPCR-seg18.6..Recoded | CTGACGACCACACATCATATTAAGT |
| mAsPCR-seg18.6..Reverse | GCCGCCTTTTCTTTTTCCGA |
| mAsPCR-seg18.6..Wild-Type | CTGACGACCACACATCATATTAAGC |
| mAsPCR-seg18.7..Recoded | CTTGACTTCGATGCACTGATTAACT |
| mAsPCR-seg18.7..Reverse | GTCCTTCAGCATCTTCTTCCAGA |
| mAsPCR-seg18.7..Wild-Type | CTTGACTTCGATGCACTGATTAACA |
| mAsPCR-seg18.8..Recoded | CGATTAGCTCCCTGATGATATTACGA |
| mAsPCR-seg18.8..Reverse | GTAAACCCCTGAATATTGTCATTAAGCT |
| mAsPCR-seg18.8..Wild-Type | CGATTAGCTCCCTGATGATATTAACT |
| mAsPCR-seg19.1..Recoded | GATTTTGCCAGCACCATACCAATTGA |
| mAsPCR-seg19.1..Reverse | AATTGGTTATAAGGAGAGAGTATGCGT |

TABLE 4-continued

MASC primers (SEQ ID NOS 175-2262, respectively, in order of appearance) used for analysis of recoded segments.

| Primer | Sequence |
| --- | --- |
| mAsPCR-seg19.1..Wild-Type | CTTTTTGCCAGCACCATACCAATACT |
| mAsPCR-seg19.2..Recoded | CGGTTCGTTTTATCTATCAGGTTCA |
| mAsPCR-seg19.2..Reverse | TATATCCGCGCCAGTCAGTTTT |
| mAsPCR-seg19.2..Wild-Type | CGGTTCGTTTTATTTAAGTGGTAGC |
| mAsPCR-seg19.3..Recoded | CGGATCTGCTATCGTGCCTT |
| mAsPCR-seg19.3..Reverse | AACAGACCAGTATCGAGATAATCCG |
| mAsPCR-seg19.3..Wild-Type | CGGATCTGCTAAGCTGCTTG |
| mAsPCR-seg19.4..Recoded | GCGACTCAGAACGTATGCATCTT |
| mAsPCR-seg19.4..Reverse | GCCACCTTCAATTCCTTCCG |
| mAsPCR-seg19.4..Wild-Type | GCGACAGTGAAAGAATGCATTTG |
| mAsPCR-seg19.5..Recoded | TGAACAAGAAACACTTCCGCTTT |
| mAsPCR-seg19.5..Reverse | AATTCACCATCGCCAATATGCAC |
| mAsPCR-seg19.5..Wild-Type | TGAACAAGAAACACTTCCGCTTA |
| mAsPCR-seg19.6..Recoded | CGATCACTTTTTGGCTCTTACTCT |
| mAsPCR-seg19.6..Reverse | GGGTATTGCGCGTAGATTTCTC |
| mAsPCR-seg19.6..Wild-Type | CGATCATTGTTTGGCAGTTACAGC |
| mAsPCR-seg19.7..Recoded | GCAAAAAGATGGCCTCGACT |
| mAsPCR-seg19.7..Reverse | GTCAGCTCCATTCCTTTCTTTTTACG |
| mAsPCR-seg19.7..Wild-Type | GCAAAAAGATGGCCTCGACA |
| mAsPCR-seg19.8..Recoded | ATGATTTCGGCCAAGAGGAGAGT |
| mAsPCR-seg19.8..Reverse | CGCCAATATCATCCGCAACATT |
| mAsPCR-seg19.8..Wild-Type | ATGATTTCGGCCAAGAGGAGAGA |
| mAsPCR-seg20.1..Recoded | GGTAACTGAATGCTCTTTTTTATGCATTAA |
| mAsPCR-seg20.1..Reverse | CTTAAACGTGAGAAACAGGACGAATC |
| mAsPCR-seg20.1..Wild-Type | GGTAACTGAATGCTCTTTTTTATGCATTAC |
| mAsPCR-seg20.2..Recoded | CGCTTTATTTTCTCTGAATCCTGGGA |
| mAsPCR-seg20.2..Reverse | GGAGGTTGGATCTTGTTTTTGTCTAC |
| mAsPCR-seg20.2..Wild-Type | CGCTTTATTTTCTCGCTATCCTGACT |
| mAsPCR-seg20.3..Recoded | CCAGCTACCGGATATGTCTTCA |
| mAsPCR-seg20.3..Reverse | GCCGATCCAACCGTTAGC |
| mAsPCR-seg20.3..Wild-Type | CCAGTTACCGGATATGAGTAGC |
| mAsPCR-seg20.4..Recoded | GAATTTCTTGTTGTTCTTTCAGATTCA |
| mAsPCR-seg20.4..Reverse | CTATATACATCTTCAAAAACAGGCAAGGTT |
| mAsPCR-seg20.4..Wild-Type | GAATTTCTTGTTGTTCTTTCAGATAGC |
| mAsPCR-seg20.5..Recoded | TCCCGGAGTGTTTCATCTGAT |
| mAsPCR-seg20.5..Reverse | GCAAATCATCTGCGCCTCTG |
| mAsPCR-seg20.5..Wild-Type | TCCCGTAACGTCTCATCGCTG |
| mAsPCR-seg20.6..Recoded | GACGGCGCTTTACCCAGT |

TABLE 4-continued

MASC primers (SEQ ID NOS 175-2262, respectively, in order of appearance) used for analysis of recoded segments.

| Primer | Sequence |
| --- | --- |
| mAsPCR-seg20.6..Reverse | GGCAAACCCGGAAAACCG |
| mAsPCR-seg20.6..Wild-Type | GACGGCGCTTTACCCAGC |
| mAsPCR-seg20.7..Recoded | GCTTCCTGACAGTACAAAAACGACTA |
| mAsPCR-seg20.7..Reverse | CCTACCAAACCCGCACTGATT |
| mAsPCR-seg20.7..Wild-Type | GCTTCCTGACAGTACAAAAAGGCTC |
| mAsPCR-seg20.8..Recoded | CCTGAAGAGAAGATTTAGTGATGAGTAGA |
| mAsPCR-seg20.8..Reverse | CCATTTAGGGCTGATTTATTACTACACAC |
| mAsPCR-seg20.8..Wild-Type | CCTGCAAAGAAGATTTAGTGATCAACAAT |
| mAsPCR-seg21.1..Recoded | GTTATGCCGCGATCGTGAAG |
| mAsPCR-seg21.1..Reverse | ATATCACCGACTTTTCCCGTCTTAA |
| mAsPCR-seg21.1..Wild-Type | GTTATGCCGCGATCGTGTAA |
| mAsPCR-seg21.2..Recoded | CTGGCACAAAATATCTGGCAGTTTC |
| mAsPCR-seg21.2..Reverse | AAGACATTGGGATTAGCAGCAGTA |
| mAsPCR-seg21.2..Wild-Type | CTGGCACAAAATATCTGGCAGTTTT |
| mAsPCR-seg21.3..Recoded | GTCAAACCAGCCAAAAACCGA |
| mAsPCR-seg21.3..Reverse | TCTGATGCTCGAACCCACTAAACTTAT |
| mAsPCR-seg21.3..Wild-Type | GTCAAACCAGCCAAAAACGCT |
| mAsPCR-seg21.4..Recoded | GTCGAGGACTACCATGAACAAGTTTC |
| mAsPCR-seg21.4..Reverse | GTTTGCATCACCGTTTGCATTTT |
| mAsPCR-seg21.4..Wild-Type | GTCGAGGACTACCATGAACAAGTTTT |
| mAsPCR-seg21.5..Recoded | CAGTGTTTCAGACGGAATGAGAG |
| mAsPCR-seg21.5..Reverse | AACTACTCTGCTCATGGTCGTC |
| mAsPCR-seg21.5..Wild-Type | CAGTGTTTCAGACGGAAGCTTAA |
| mAsPCR-seg21.6..Recoded | GTAATGCCAAATCCTTCAGACTTAAATGA |
| mAsPCR-seg21.6..Reverse | GGTATGTGTTCTTGATGGCGAAAT |
| mAsPCR-seg21.6..Wild-Type | GTAATGCCAAATCCTTCACTCTTAAAGCT |
| mAsPCR-seg21.7..Recoded | TACAAATAACCATCTCATCTGCCTGA |
| mAsPCR-seg21.7..Reverse | TTGACTCAGAAGGGTGGGTTAC |
| mAsPCR-seg21.7..Wild-Type | TACAAATAACCATCTCATCTGCCTGC |
| mAsPCR-seg21.8..Recoded | GCGATCGTAGGAGTTTGATGA |
| mAsPCR-seg21.8..Reverse | GACCGCTACAACTCAGAAAAGAC |
| mAsPCR-seg21.8..Wild-Type | GCGATCGTAACTGTTGCTGCT |
| mAsPCR-seg22.1..Recoded | CAATAATCGTAAAGGGGCAGTTTC |
| mAsPCR-seg22.1..Reverse | GCTGTAGATGCGGGAGATATT |
| mAsPCR-seg22.1..Wild-Type | CAATAATCGTAAAGGGGCCGTCAG |
| mAsPCR-seg22.2..Recoded | CTTTCATCCATGTCATTTGCCTCA |
| mAsPCR-seg22.2..Reverse | GGTATCGTCTGGCTGTATTCGT |

TABLE 4-continued

MASC primers (SEQ ID NOS 175-2262, respectively, in order of appearance) used for analysis of recoded segments.

| Primer | Sequence |
| --- | --- |
| mAsPCR-seg22.2...Wild-Type | TTAAGCTCCATGTCATTTGCCAGC |
| mAsPCR-seg22.3...Recoded | TGTCTTTCACCGCCATCACA |
| mAsPCR-seg22.3...Reverse | GCACTTCCCTCGTTTGTCCA |
| mAsPCR-seg22.3...Wild-Type | TGTCTTTCACCGCCATCACT |
| mAsPCR-seg22.4...Recoded | GCTTCTGATAATACTCTTCATAAATTGAGGA |
| mAsPCR-seg22.4...Reverse | GCAGCCTTTAACTCCGATAACC |
| mAsPCR-seg22.4...Wild-Type | GCTTCTGATAATACTCTTCATAAATGCTGCT |
| mAsPCR-seg22.5...Recoded | GGGCTTATCAATGTGACCCTATCA |
| mAsPCR-seg22.5...Reverse | CGGTCATGATTTCTGCAATACCTG |
| mAsPCR-seg22.5...Wild-Type | GGGCTTATCAATGTGACCTTAAGT |
| mAsPCR-seg22.6...Recoded | CAGTTTGATCACTTCGTCATTAATAGAGAG |
| mAsPCR-seg22.6...Reverse | CGGTCTGTCACTGATTCGC |
| mAsPCR-seg22.6...Wild-Type | CAGTTTGATCACTTCGTCATTAATAGATAA |
| mAsPCR-seg22.7...Recoded | GAACCACAGAGAGAGTGAATGATGA |
| mAsPCR-seg22.7...Reverse | TGATTGACAAGGGTATTTTTATGAA |
| mAsPCR-seg22.7...Wild-Type | GAACCACAGATAAAGTGAAGCTACT |
| mAsPCR-seg22.8...Recoded | GGCGCTCGATCTGACACTT |
| mAsPCR-seg22.8...Reverse | TACGGACAGTGACAGCGTTG |
| mAsPCR-seg22.8...Wild-Type | GGCGCTCGATCTGACATTG |
| mAsPCR-seg23.1...Recoded | GGAACGTTTTATGCTGGAGTTTCTC |
| mAsPCR-seg23.1...Reverse | TCTGCCGGGTGATCTTGC |
| mAsPCR-seg23.1...Wild-Type | GGAACGTTTTATGCTGGAGTTTTTG |
| mAsPCR-seg23.2...Recoded | CGGTGATGACGCTATCTTCA |
| mAsPCR-seg23.2...Reverse | CCATCAAGGGTAAAGCGTGATTTATC |
| mAsPCR-seg23.2...Wild-Type | CGGTGATGACGCTAAGCAGT |
| mAsPCR-seg23.3...Recoded | AAACAAAGAAAGATACAGGCTGGAATAAG |
| mAsPCR-seg23.3...Reverse | GTATCCCACTCAGCCCTAATCG |
| mAsPCR-seg23.3...Wild-Type | AAACACAAAAGATACAGGCTGGAATTAA |
| mAsPCR-seg23.4...Recoded | TAGATGACGGTTAGTTTCAGCGAGA |
| mAsPCR-seg23.4...Reverse | TGGAAGATGCCTGGGAATATATGG |
| mAsPCR-seg23.4...Wild-Type | TAAATGACGGTTAGTTTCAGCGAGC |
| mAsPCR-seg23.5...Recoded | GAGAATGGCACCGACGAAAATT |
| mAsPCR-seg23.5...Reverse | GTCAAGGTGTTCAGGCGTTTATTT |
| mAsPCR-seg23.5...Wild-Type | GAGAATGGCACCGACGAAAATA |
| mAsPCR-seg23.6...Recoded | TGCCGCAGTTTTCATTAGGAG |
| mAsPCR-seg23.6...Reverse | CATCAAGCTCAAAATGGATAACTGG |
| mAsPCR-seg23.6...Wild-Type | TGCCGCAGTTTTCATCAACAA |
| mAsPCR-seg23.7...Recoded | CGGACAACTGAAAAGGCTGATG |

TABLE 4-continued

MASC primers (SEQ ID NOS 175-2262, respectively, in order of appearance) used for analysis of recoded segments.

| Primer | Sequence |
| --- | --- |
| mAsPCR-seg23.7..Reverse | ATTTTTTACATTTTCGATAAATTCATCTGCA |
| mAsPCR-seg23.7..Wild-Type | CGGACAACACTAAAGGCGCTAC |
| mAsPCR-seg23.8..Recoded | CTCTACGTGCTGATTAACCTGTTGT |
| mAsPCR-seg23.8..Reverse | GCATGGCTCCCGAAAACAT |
| mAsPCR-seg23.8..Wild-Type | CTCTACGTGCTGATTAACCTGTTGA |
| mAsPCR-seg24.1..Recoded | TGTGAGGAGTGGTTATAGAAATAAGAAGTT |
| mAsPCR-seg24.1..Reverse | GAAAACTGTCGCCTTTAATACCAATG |
| mAsPCR-seg24.1..Wild-Type | TGGCTGGAGTGGTTATAGAAATAAGAAGTG |
| mAsPCR-seg24.2..Recoded | GATGCCATCGATGTGACCTC |
| mAsPCR-seg24.2..Reverse | TTCTTCCCAGACAGCATCCAG |
| mAsPCR-seg24.2..Wild-Type | GATGCCATCGATGTGACCAG |
| mAsPCR-seg24.3..Recoded | CGTTCCTGGTAATTGTATGAAGATTGT |
| mAsPCR-seg24.3..Reverse | AGCCCTATTTACACCGATGATTTC |
| mAsPCR-seg24.3..Wild-Type | CGTTCCTGGTAATTGTATGAAGATTGC |
| mAsPCR-seg24.4..Recoded | ACTGCTATCTTCAAATCGCTGATCT |
| mAsPCR-seg24.4..Reverse | AACAGAGTCAACAACAACAACAGAC |
| mAsPCR-seg24.4..Wild-Type | ACTGCTATCTTCAAATCGCTGATCA |
| mAsPCR-seg24.5..Recoded | GCGCCAGTTGTTTCAGGTATG |
| mAsPCR-seg24.5..Reverse | CCTATACCCGGAATATGTACATTGTGA |
| mAsPCR-seg24.5..Wild-Type | GCGCCAGTTGTTTCAGGTAGC |
| mAsPCR-seg24.6..Recoded | TCCTGTTCTGGAGGGGTCA |
| mAsPCR-seg24.6..Reverse | GGCAGGAACAIGTTGATTTCGATC |
| mAsPCR-seg24.6..Wild-Type | TCCTGTTCTGGAGGGGAGT |
| mAsPCR-seg24.7..Recoded | CACGTTCAGTCATTAAAGATTCCATGT |
| mAsPCR-seg24.7..Reverse | CCATTTGCTTTTCCTCATTTAGAATCG |
| mAsPCR-seg24.7..Wild-Type | CACGTTCAGTCATTAAAGATTCCATGA |
| mAsPCR-seg24.8..Recoded | GGCACAACGTGACGGTAATCT |
| mAsPCR-seg24.8..Reverse | GCCACATACTTTATTCTCACCCAGA |
| mAsPCR-seg24.8..Wild-Type | GGCACAACGTGACGGTAATCA |
| mAsPCR-seg25.1..Recoded | CGGGGCCAATACCTCACTAC |
| mAsPCR-seg25.1..Reverse | CGGCATATTCACGTTCAACTTCA |
| mAsPCR-seg25.1..Wild-Type | CGGGGCCAATACCAGTTTGT |
| mAsPCR-seg25.2..Recoded | TCAACACCTCAGATGAAGTTATTCTTTCT |
| mAsPCR-seg25.2..Reverse | TCTATTGCCAGATTGACGAAAGC |
| mAsPCR-seg25.2..Wild-Type | TCAACACCAGTGATGAAGTTATTCTTAGC |
| mAsPCR-seg25.3..Recoded | TTACTTTAGCATATTACGAATGACATAATGT |
| mAsPCR-seg25.3..Reverse | GCACCTTCGCCAATATTCGC |

TABLE 4-continued

MASC primers (SEQ ID NOS 175-2262, respectively, in order of appearance) used for analysis of recoded segments.

| Primer | Sequence |
| --- | --- |
| mAsPCR-seg25.3..Wild-Type | TTACTTCAACATATTACGAATGACATAATGC |
| mAsPCR-seg25.4..Recoded | GCGGGAAGAAGATGAAGCAGTA |
| mAsPCR-seg25.4..Reverse | TTACCACCTAAATGAACCGGAAGA |
| mAsPCR-seg25.4..Wild-Type | GCGGGAAGAAGATGAAGCAGTT |
| mAsPCR-seg25.5..Recoded | ATTTCACTTTCCCTTCTCGAAAAGC |
| mAsPCR-seg25.5..Reverse | TCTGCGTTGATGATTTTTCGTGTT |
| mAsPCR-seg25.5..Wild-Type | ATTTCACTTTCCCTTCTCGAAAAGT |
| mAsPCR-seg25.6..Recoded | TGAAAGCATTTGAAGGTCATGCGA |
| mAsPCR-seg25.6..Reverse | CCGTGCCATTGAACTGCTG |
| mAsPCR-seg25.6..Wild-Type | GCTAAGCATTTGTAAGTCATGGCT |
| mAsPCR-seg25.7..Recoded | CGCTACGACCGGGAAAAG |
| mAsPCR-seg25.7..Reverse | GAAGAAGCAGGTCTGGGTCAG |
| mAsPCR-seg25.7..Wild-Type | CGCTACGACCGGGAACAA |
| mAsPCR-seg25.8..Recoded | ATTCACTGAACTGAAAACCATCTGGATATC |
| mAsPCR-seg25.8..Reverse | GGAGAGCCCGGTATAGCC |
| mAsPCR-seg25.8..Wild-Type | ATTCACTGAACTGAAAACCATCTGGATAAG |
| mAsPCR-seg26.1..Recoded | CCTTCTCCCTGAATCGGAAATACTT |
| mAsPCR-seg26.1..Reverse | ACATTCGTTTTATTTCTTCTTTACAGCCT |
| mAsPCR-seg26.1..Wild-Type | CTTGTTGCCTGAAAGCGAAATATTA |
| mAsPCR-seg26.2..Recoded | GAGTATGAAGATCGGGCGATTCTT |
| mAsPCR-seg26.2..Reverse | CAGCGTTTTGATCTCTTTACCTACATC |
| mAsPCR-seg26.2..Wild-Type | GAGTATGAAGATCGGGCGATTTTA |
| mAsPCR-seg26.3..Recoded | TCCGATAAATTCCATTATGCCGGAGTA |
| mAsPCR-seg26.3..Reverse | AGTGCGTGATGAATGGATTGTTG |
| mAsPCR-seg26.3..Wild-Type | AGTGATAAATTCCATTATGCAGGTGTC |
| mAsPCR-seg26.4..Recoded | CGTATTTCGGCCATCAGTGATG |
| mAsPCR-seg26.4..Reverse | GTGGATTGACGATGACAAACC |
| mAsPCR-seg26.4..Wild-Type | CGTATTTCGGCCATCAGACTGC |
| mAsPCR-seg26.5..Recoded | GCTGACCAAATGACCAGATATGAAG |
| mAsPCR-seg26.5..Reverse | GCGCCAAACTATGCCGAAG |
| mAsPCR-seg26.5..Wild-Type | GCTGACCAAAACTCCAGATATGTAA |
| mAsPCR-seg26.6..Recoded | GAAGAGATTTATCGTGGCACCTC |
| mAsPCR-seg26.6..Reverse | CGGCGGTGATCTCAGAAATTTT |
| mAsPCR-seg26.6..Wild-Type | GAAGAGATTTATCGTGGCACCAG |
| mAsPCR-seg26.7..Recoded | CTTTTCAAATACAACGATGCTGGA |
| mAsPCR-seg26.7..Reverse | AAGTCGGGGAACTCTTCTTTTGA |
| mAsPCR-seg26.7..Wild-Type | TTGTTCAAATACAACGATGCAGGT |
| mAsPCR-seg26.8..Recoded | CTATCTCTTGAACCGGGATCCTA |

TABLE 4-continued

MASC primers (SEQ ID NOS 175-2262, respectively, in order of appearance) used for analysis of recoded segments.

| Primer | Sequence |
| --- | --- |
| mAsPCR-seg26.8..Reverse | GCAGCAGTCCATAACCGAAAAG |
| mAsPCR-seg26.8..Wild-Type | CTAAGCCTTGAACCGGTGATCTTG |
| mAsPCR-seg27.1..Recoded | TTTATCCGCAAACGCATCTGTC |
| mAsPCR-seg27.1..Reverse | AAAGGTGGCAGGATGTTTACGA |
| mAsPCR-seg27.1..Wild-Type | TTTATCCGCAAACGCATCTGAG |
| mAsPCR-seg27.2..Recoded | AGAACTCACCATCTTTTATCGCAATT |
| mAsPCR-seg27.2..Reverse | CAACTCACCGAAGAACAGTACCA |
| mAsPCR-seg27.2..Wild-Type | AGAACTCACCATCTTTTATCGCAATA |
| mAsPCR-seg27.3..Recoded | CCGGATCGTCTACCTCTGCTA |
| mAsPCR-seg27.3..Reverse | GCCAATGGAAAGCTGATGTTTCA |
| mAsPCR-seg27.3..Wild-Type | CCGGATGGTTTACCTCTGTTG |
| mAsPCR-seg27.4..Recoded | GTTCACTTCTTGTTGTTTCATCATTCTCA |
| mAsPCR-seg27.4..Reverse | CTTTACCAATACCTGAGATGTAAACGG |
| mAsPCR-seg27.4..Wild-Type | GTTCATTGCTTGTTGTTTCATCATTCAGT |
| mAsPCR-seg27.5..Recoded | GATTATCTACCGCTGTATCTGGAGTATC |
| mAsPCR-seg27.5..Reverse | GATATTGATTAAGCGGCGAAGAGTC |
| mAsPCR-seg27.5..Wild-Type | GATTATCTACCGCTGTATCTGGAGTATT |
| mAsPCR-seg27.6..Recoded | TCAATCAGATGACCAGAGTACTTTGA |
| mAsPCR-seg27.6..Reverse | CGCGGGATGATCAATATGCTG |
| mAsPCR-seg27.6..Wild-Type | TCAATCAGATGACCGCTGTACTTACT |
| mAsPCR-seg27.7..Recoded | AAACAACAACGACGCAACCCTT |
| mAsPCR-seg27.7..Reverse | TTCGAAAGCAAAATCATCACGCA |
| mAsPCR-seg27.7..Wild-Type | AAACAACAACGACGCAACCTTG |
| mAsPCR-seg27.8..Recoded | AAAGTTCAAAAGAGATTATATCCCTTCTTCT |
| mAsPCR-seg27.8..Reverse | CACGCCATCCTGATCCATATGTATA |
| mAsPCR-seg27.8..Wild-Type | AAAGTTCAAAAGAGATTATATCCCTTCTTCA |
| mAsPCR-seg28.1..Recoded | GGCGGTAGGGAGTTACGAAG |
| mAsPCR-seg28.1..Reverse | TTTCATTTGCTTATGTGCTGGTCAA |
| mAsPCR-seg28.1..Wild-Type | GGCGGTAGGGAGTTACGTAA |
| mAsPCR-seg28.2..Recoded | CTTGTTACAAAGTAAGAATGGGAGTTTATGA |
| mAsPCR-seg28.2..Reverse | CGGGTTCACGGCTAAATGATAAC |
| mAsPCR-seg28.2..Wild-Type | CTTGTTACAAAGTAAGAATGGGAGTTTAACT |
| mAsPCR-seg28.3..Recoded | TTAAAATGGATAAGAAGCAAGTAACGGATC |
| mAsPCR-seg28.3..Reverse | CCAGTAGCGGGCGAATTTATG |
| mAsPCR-seg28.3..Wild-Type | TTAAAATGGATAAGAAGCAAGTAACGATT |
| mAsPCR-seg28.4..Recoded | TGAAATTTTCATCCGTCAGTTTGAAT |
| mAsPCR-seg28.4..Reverse | CATAATGTGGTAAAGCGGTACAC |

TABLE 4-continued

MASC primers (SEQ ID NOS 175-2262, respectively, in order of appearance) used for analysis of recoded segments.

| Primer | Sequence |
| --- | --- |
| mAsPCR-seg28.4..Wild-Type | TGAAATTTTCATCCGTCAGTTTGAAA |
| mAsPCR-seg28.5..Recoded | ATCTGGCTGGCACAATATTACTCTT |
| mAsPCR-seg28.5..Reverse | CGACGTTATTGCCAGGTGTAGA |
| mAsPCR-seg28.5..Wild-Type | ATCTGGCTGGCACAATATTACTTTG |
| mAsPCR-seg28.6..Recoded | GCTTTCACTTTCGCTGCCACTA |
| mAsPCR-seg28.6..Reverse | CTTTATAAGGCGTGAGTACTTCTTCAA |
| mAsPCR-seg28.6..Wild-Type | GTTGTCACTTTCGCTGCCATTG |
| mAsPCR-seg28.7..Recoded | GGGTTTGCAATGGTTACTTCTGA |
| mAsPCR-seg28.7..Reverse | GTCTTTAATCATACCAATAACTCAGATGCC |
| mAsPCR-seg28.7..Wild-Type | GGGTTTGCAATGGTTACTTCACT |
| mAsPCR-seg28.8..Recoded | CGTTCATGCTTACTACGATATTCTATCA |
| mAsPCR-seg28.8..Reverse | GCTGCTGTTCTGACTGGT |
| mAsPCR-seg28.8..Wild-Type | CGTTCATGCTTACTACGATATTTTGAGC |
| mAsPCR-seg29.1..Recoded | TGGCCATCGCTGTCTGGT |
| mAsPCR-seg29.1..Reverse | GGCAATAACCGACACAATAACG |
| mAsPCR-seg29.1..Wild-Type | TGGCCATCGCTGTCTGGA |
| mAsPCR-seg29.2..Recoded | GTTCTAAAGGATTTTATTGATGCACTTTCG |
| mAsPCR-seg29.2..Reverse | GAATGGCGGTGATAAGGTTAGGA |
| mAsPCR-seg29.2..Wild-Type | GTTTTAAAGGATTTTATTGATGCACTTAGT |
| mAsPCR-seg29.3..Recoded | CTACATCCACTAAATCATTACAACTCCTGA |
| mAsPCR-seg29.3..Reverse | CGCTACTGGGACGCTATGAA |
| mAsPCR-seg29.3..Wild-Type | TTACATCCATTAAATCATTACAACAGCTAG |
| mAsPCR-seg29.4..Recoded | GTGTTGCTGTCGATCCGGTA |
| mAsPCR-seg29.4..Reverse | CAAGCGGTGTCTGTGAGTTATTAATC |
| mAsPCR-seg29.4..Wild-Type | GTGTTGCTGTCGATCCGGTG |
| mAsPCR-seg29.5..Recoded | TCCTGTGAGCGCATACAGTC |
| mAsPCR-seg29.5..Reverse | AGAAGGGTATGAGTAATAAGGTGGGA |
| mAsPCR-seg29.5..Wild-Type | TCCTGTGAGCGCATACAGAG |
| mAsPCR-seg29.6..Recoded | TCACTGAGAGTTGTACGTTGTAGAGAAG |
| mAsPCR-seg29.6..Reverse | CTTGCCGCCTCCTGTTTTG |
| mAsPCR-seg29.6..Wild-Type | TCACTGAGAGTTGTACGTTGTAGAGTAA |
| mAsPCR-seg29.7..Recoded | CATAATTAGAATGCCGTGCCATG |
| mAsPCR-seg29.7..Reverse | GCCTATCCTTCCGGTGCTTT |
| mAsPCR-seg29.7..Wild-Type | CATAATCAAAATGCCGTGCCAGC |
| mAsPCR-seg29.8..Recoded | GCGGAACCCAGATAAGCAAG |
| mAsPCR-seg29.8..Reverse | CGTTTTGCCGCCGAGATC |
| mAsPCR-seg29.8..Wild-Type | GCGGAACCCAGATAAGCTAA |
| mAsPCR-seg30.1..Recoded | CAAAATAGGGAATAATCGACCACATTGA |

TABLE 4-continued

MASC primers (SEQ ID NOS 175-2262, respectively, in order of appearance) used for analysis of recoded segments.

| Primer | Sequence |
| --- | --- |
| mAsPCR-seg30.1..Reverse | CTTTGGTCAGTGTGGCTTGC |
| mAsPCR-seg30.1..Wild-Type | CAAAATAGGGAATAATCGACCACATACT |
| mAsPCR-seg30.2..Recoded | CAAGGGCCGCAGCTTTAAG |
| mAsPCR-seg30.2..Reverse | GGTACTGGACTAAATACCCATCCG |
| mAsPCR-seg30.2..Wild-Type | CAAGGGCCGCAGCTTTTAA |
| mAsPCR-seg30.3..Recoded | GCGATATATCCCGAAAGCCCTAG |
| mAsPCR-seg30.3..Reverse | TGCAAACCCTGAAACGGAATC |
| mAsPCR-seg30.3..Wild-Type | GCGATATATCCGCTTAACCCCAA |
| mAsPCR-seg30.4..Recoded | CCTGCAATCCTCGAAGCACTC |
| mAsPCR-seg30.4..Reverse | CCAAATACGCCGTGCATCAG |
| mAsPCR-seg30.4..Wild-Type | CCTGCAATCCTCGAAGCATTA |
| mAsPCR-seg30.5..Recoded | TTCGAGTGATGAGATTTTGCGAAATTTA |
| mAsPCR-seg30.5..Reverse | AAGTAAGCTCTGCACTTGTGGA |
| mAsPCR-seg30.5..Wild-Type | TTCGAGTGAACTGATTTTGCGAAATTTT |
| mAsPCR-seg30.6..Recoded | ATCGCCTCGGTCGTTTCT |
| mAsPCR-seg30.6..Reverse | CATCTGCACCGTCAAACAGTG |
| mAsPCR-seg30.6..Wild-Type | ATCGCCTCGGTGGTCAGC |
| mAsPCR-seg30.7..Recoded | GGCTTGATCCGAAGAAAACCT |
| mAsPCR-seg30.7..Reverse | GCCGCCTGTAGACCTTCTT |
| mAsPCR-seg30.7..Wild-Type | GGTTGGATCCGAAGAAAACCA |
| mAsPCR-seg30.8..Recoded | TCACCTGGGAGCCATTGG |
| mAsPCR-seg30.8..Reverse | GTAGCTGGTCAGGGCGTAC |
| mAsPCR-seg30.8..Wild-Type | TCACCTGACTGCCATTGC |
| mAsPCR-seg31.1..Recoded | CTATACCGATTACCCGACGCTA |
| mAsPCR-seg31.1..Reverse | CGCATCGGTTTTGGCGTT |
| mAsPCR-seg31.1..Wild-Type | CTATACCGATTACCCGACGTTG |
| mAsPCR-seg31.2..Recoded | GTCGCGGAATTTATGTACCAGTCA |
| mAsPCR-seg31.2..Reverse | GACGAAATACTTCATCAGACACCCA |
| mAsPCR-seg31.2..Wild-Type | GTCGCGGAATTTATGTACCAGAGC |
| mAsPCR-seg31.3..Recoded | GCCGCATCTTTTGGCTCA |
| mAsPCR-seg31.3..Reverse | GGGACTGGCACTTCTTCTGG |
| mAsPCR-seg31.3..Wild-Type | GCCGCATCTTTTGGCAGC |
| mAsPCR-seg31.4..Recoded | ACCAGATTGCCCTGAACTTTTCA |
| mAsPCR-seg31.4..Reverse | CCCATAGGTTCAACGACCAGAT |
| mAsPCR-seg31.4..Wild-Type | ACCAGATTGCCCTGAACTTTAGT |
| mAsPCR-seg31.5..Recoded | GAAAGGCTGGTCGTGCATA |
| mAsPCR-seg31.5..Reverse | TCTATTCGTCGCCTACTTGCC |

TABLE 4-continued

MASC primers (SEQ ID NOS 175-2262, respectively, in order of appearance) used for analysis of recoded segments.

| Primer | Sequence |
|---|---|
| mAsPCR-seg31.5..Wild-Type | GAAAGGCTGGTCGTGCATC |
| mAsPCR-seg31.6..Recoded | CGGTTGTCATTGTTGAACTCAAGT |
| mAsPCR-seg31.6..Reverse | GATGATCGAAAAATGTATCCGTGCA |
| mAsPCR-seg31.6..Wild-Type | CGGTTGTCATTGTTGAACTCGAGA |
| mAsPCR-seg31.7..Recoded | GCTGGAACACAATAAAGGTTTTTGTAACT |
| mAsPCR-seg31.7..Reverse | CGCCGTGTGAGCATTTCA |
| mAsPCR-seg31.7..Wild-Type | GCTGGAACACAATAAAGGTTTTTGTAACA |
| mAsPCR-seg31.8..Recoded | GCAATTAGCGTCCGTAGTGAA |
| mAsPCR-seg31.8..Reverse | TGTCCGTCGATGAAGATCACC |
| mAsPCR-seg31.8..Wild-Type | GCAATTAACGTCCGCAAACTG |
| mAsPCR-seg32.1..Recoded | GCTCATCTGTCCCAACGATCA |
| mAsPCR-seg32.1..Reverse | CACACTGCCAGACCGTAG |
| mAsPCR-seg32.1..Wild-Type | GCTCATCTGTCCCAAAGAAGT |
| mAsPCR-seg32.2..Recoded | TTTGCCGTCGGTAATTTCTGTTTTA |
| mAsPCR-seg32.2..Reverse | GTATTGTGATGATGCAAGTCCAGAAA |
| mAsPCR-seg32.2..Wild-Type | TTTGCCGTCGGTAATTTCTGTTTTT |
| mAsPCR-seg32.3..Recoded | AACTTAACTCTGTCTGGGTCTTTTCA |
| mAsPCR-seg32.3..Reverse | CGCGACAGAGAATTTCATGACG |
| mAsPCR-seg32.3..Wild-Type | AATTAAACAGCGTCTGGGTCTTTAGC |
| mAsPCR-seg32.4..Recoded | CCACCACCAGATGTTCAGGA |
| mAsPCR-seg32.4..Reverse | GCGCAAACTACTTCTTCAGGTAAA |
| mAsPCR-seg32.4..Wild-Type | CCACCACCAGATGTTCAGGT |
| mAsPCR-seg32.5..Recoded | AAGGACTGGCGATTGTGATGT |
| mAsPCR-seg32.5..Reverse | AGTGCTGTGATGAGAATAAGGCA |
| mAsPCR-seg32.5..Wild-Type | AAGGACTGGCGATTGTGATGA |
| mAsPCR-seg32.6..Recoded | CAGCTGGACTTCTCTCTTCCT |
| mAsPCR-seg32.6..Reverse | AATCTTCTCATTACGTAGGTCTGCTT |
| mAsPCR-seg32.6..Wild-Type | CAGCTGGACTTCTCTTTGCCG |
| mAsPCR-seg32.7..Recoded | CGACCGTCGGACAACCCTT |
| mAsPCR-seg32.7..Reverse | CACAAGAGATATGCAGGACACT |
| mAsPCR-seg32.7..Wild-Type | CGACCGTCGGACAACCTTA |
| mAsPCR-seg32.8..Recoded | GGTATAAAAATCACCCAACCTAGAATACG |
| mAsPCR-seg32.8..Reverse | CTTATGATTAAGCGCCTATCATATCGC |
| mAsPCR-seg32.8..Wild-Type | GGTATAAAAATCACCCAACCCAAAATCCT |
| mAsPCR-seg33.1..Recoded | GCATCCCTATGGCGAGTGAT |
| mAsPCR-seg33.1..Reverse | AAATGGGCGAATACTACAAAGGC |
| mAsPCR-seg33.1..Wild-Type | GCATCCCTATGGCCAGACTC |
| mAsPCR-seg33.2..Recoded | CGACCCCTCCCCAAATGA |

TABLE 4-continued

MASC primers (SEQ ID NOS 175-2262, respectively, in order of appearance) used for analysis of recoded segments.

| Primer | Sequence |
| --- | --- |
| mAsPCR-seg33.2...Reverse | GGCTGACAGATAATCGTCGATGA |
| mAsPCR-seg33.2...Wild-Type | CGACCCCTCCCCAAACCT |
| mAsPCR-seg33.3...Recoded | GCTGGAATCAAATAAAGCCGAAC |
| mAsPCR-seg33.3...Reverse | TTATTACCGCCCATCTCAAGGG |
| mAsPCR-seg33.3...Wild-Type | GCTGGAAAGCAATAAAGCCGAAT |
| mAsPCR-seg33.4...Recoded | GCATCGACTATGAAATCCGCTCA |
| mAsPCR-seg33.4...Reverse | GGTGGCAATGATGAAAAGCAGAATATA |
| mAsPCR-seg33.4...Wild-Type | GCATCGACTATGAAATCCGCAGC |
| mAsPCR-seg33.5...Recoded | CCATCAAGCAGACGGTTTAGT |
| mAsPCR-seg33.5...Reverse | AATGATGGCGGCAACAACTTC |
| mAsPCR-seg33.5...Wild-Type | CCATCAAGCAGCCTGTTCAAC |
| mAsPCR-seg33.6...Recoded | CTGATAGCGACACTGCTTTTCTG |
| mAsPCR-seg33.6...Reverse | TTCGGCGATGACCGGGAT |
| mAsPCR-seg33.6...Wild-Type | CTGATAGCGACACTGCTTTTCGC |
| mAsPCR-seg33.7...Recoded | AGTACCCTTGATTACTTTAACCTTTGA |
| mAsPCR-seg33.7...Reverse | GTTTCTGCTGGGTGGTATTGG |
| mAsPCR-seg33.7...Wild-Type | AGTACCCTTGATTACTTTAACCTTGCT |
| mAsPCR-seg33.8...Recoded | GTTTCATTACCGACATGCCCAAG |
| mAsPCR-seg33.8...Reverse | TGGTCGGTCAATGGAGATTATTCAT |
| mAsPCR-seg33.8...Wild-Type | GTTTCATTACCGACATGCCCTAA |
| mAsPCR-seg34.1...Recoded | TAATCAGTATTAAGTCGGCGAAGTGA |
| mAsPCR-seg34.1...Reverse | ATGGCCTGGCTATATCGTTACAC |
| mAsPCR-seg34.1...Wild-Type | TAATCAGTATTGAGACGGCGTAAACT |
| mAsPCR-seg34.2...Recoded | AGAATCTAGCCATCATCTCAAACTC |
| mAsPCR-seg34.2...Reverse | AAGTTGTCGAAAGTAGATTGCAGATG |
| mAsPCR-seg34.2...Wild-Type | AGAATTTGGCCATCATCAGCAACAG |
| mAsPCR-seg34.3...Recoded | CAATAACGGCAACCACGAAAGA |
| mAsPCR-seg34.3...Reverse | TGACCGTCACCAATAACTCGAAT |
| mAsPCR-seg34.3...Wild-Type | CAATAACGGCAACCACGAAGCT |
| mAsPCR-seg34.4...Recoded | TGTTTGATAATAATAGGCCCATTCAGCT |
| mAsPCR-seg34.4...Reverse | AATGCCACCACGCCACAG |
| mAsPCR-seg34.4...Wild-Type | TGTTTGATAATAATAGGCCCATTCAGCA |
| mAsPCR-seg34.5...Recoded | GAACCGGATAGACCCAGCGA |
| mAsPCR-seg34.5...Reverse | CGATCACCGCCAAGCTTATG |
| mAsPCR-seg34.5...Wild-Type | CTACCGGATAAACCCAGGCT |
| mAsPCR-seg34.6...Recoded | TCTTGAACAGGGTGCAATTCTCTC |
| mAsPCR-seg34.6...Reverse | TTCCACCACGAACAGCTCT |

TABLE 4-continued

MASC primers (SEQ ID NOS 175-2262, respectively, in order of appearance) used for analysis of recoded segments.

| Primer | Sequence |
| --- | --- |
| mAsPCR-seg34.6..Wild-Type | TCTTGAACAGGGTGCAATTTTAAG |
| mAsPCR-seg34.7..Recoded | GATAAAAGATCTCAATCAGTACTGGTTTTCT |
| mAsPCR-seg34.7..Reverse | ACTTATCAATTTTCAGCACGTCAGG |
| mAsPCR-seg34.7..Wild-Type | GATAAAAGATCTCAATCAGTACTGGTTTAGC |
| mAsPCR-seg34.8..Recoded | CAGTGCTCTACATCCAACTTTCA |
| mAsPCR-seg34.8..Reverse | GAAGACGCCACGAATATCTGATTG |
| mAsPCR-seg34.8..Wild-Type | CAGTGCTCTACATCCAACTTAGC |
| mAsPCR-seg35.1..Recoded | AGATATCAATATTATCTGGCCGATGATCCTT |
| mAsPCR-seg35.1..Reverse | CTTGCCGCGGGTTTTATGG |
| mAsPCR-seg35.1..Wild-Type | GGATATCAATATTATCTGGCCGATGATCTTA |
| mAsPCR-seg35.2..Recoded | AGAAACGCGATTACTTCTTTTGAGG |
| mAsPCR-seg35.2..Reverse | AAACAGAATTTTACGCGGATCTAAATC |
| mAsPCR-seg35.2..Wild-Type | AGAAACGCGATTACTTCTTTACTGC |
| mAsPCR-seg35.3..Recoded | GAAAGATGCTCGGCGGTTGA |
| mAsPCR-seg35.3..Reverse | CCGGCACCTTTAACCAGTTTATC |
| mAsPCR-seg35.3..Wild-Type | CTTAAATGCTCGGCGGTACT |
| mAsPCR-seg35.4..Recoded | CGAGGTCGTTTTATGCAGAGAA |
| mAsPCR-seg35.4..Reverse | TATGAACCAGGCTGTGAATATGCTAT |
| mAsPCR-seg35.4..Wild-Type | CGAGGTCGTTTTATGCAGGCTG |
| mAsPCR-seg35.5..Recoded | TGCTGGGTATGGACTACGGA |
| mAsPCR-seg35.5..Reverse | GCTACAAAAATGCCCGATCCTC |
| mAsPCR-seg35.5..Wild-Type | TGCTGGGTATGGACTACGGT |
| mAsPCR-seg35.6..Recoded | GGATTTATCAAACTCAGGAATGTATTCTGA |
| mAsPCR-seg35.6..Reverse | CAAAACTGCCGCGTACCG |
| mAsPCR-seg35.6..Wild-Type | GGATTTATCAAACTCAGGAATGTATTCGCT |
| mAsPCR-seg35.7..Recoded | GGTTTCGATTATATGGACCGCAAAC |
| mAsPCR-seg35.7..Reverse | GCGTTATGCCAAAGTGATTCCA |
| mAsPCR-seg35.7..Wild-Type | GGTTTCGATTATATGGACCGCAAAT |
| mAsPCR-seg35.8..Recoded | GCGCTCACTAAGTCCTGGT |
| mAsPCR-seg35.8..Reverse | TTTAGTGAAGATTTTACCGCGCTTAG |
| mAsPCR-seg35.8..Wild-Type | GCGCTCACTAAGTCCTGGA |
| mAsPCR-seg36.1..Recoded | CTGAATACCCTTAAAATTGCCTGGT |
| mAsPCR-seg36.1..Reverse | CGCCCACCAGATCATTTTGATATTC |
| mAsPCR-seg36.1..Wild-Type | CTGAATACCTTAAAAATTGCCTGGA |
| mAsPCR-seg36.2..Recoded | ATTTGCGGTAATCACAATCACTCA |
| mAsPCR-seg36.2..Reverse | CAGGATATTCGTCATCAGCTCGA |
| mAsPCR-seg36.2..Wild-Type | ATTTGCGGTAATCACAATCACAGT |
| mAsPCR-seg36.3..Recoded | CCAAACATGCCTTTCATTAGTTCTGA |

TABLE 4-continued

MASC primers (SEQ ID NOS 175-2262, respectively, in order of appearance) used for analysis of recoded segments.

| Primer | Sequence |
| --- | --- |
| mAsPCR-seg36.3..Reverse | ACAACTTAAACATCTTGGTATGGATATTGAC |
| mAsPCR-seg36.3..Wild-Type | CCAAACATGCCTTTCATTAATTCGCT |
| mAsPCR-seg36.4..Recoded | CGGAATGATGGCACTGATATGAA |
| mAsPCR-seg36.4..Reverse | GCCCCCCTATTTCTGACACC |
| mAsPCR-seg36.4..Wild-Type | CGGAATGATGGCACTGATATGAC |
| mAsPCR-seg36.5..Recoded | TAGTGATGACGCCAGAGATGAATTTCT |
| mAsPCR-seg36.5..Reverse | AGGCTGCAGTATTTTCCAAAACG |
| mAsPCR-seg36.5..Wild-Type | TAGTGATGACGCCAGAGATGAATTTCA |
| mAsPCR-seg36.6..Recoded | CCCGTCCGCTCGCTAAAC |
| mAsPCR-seg36.6..Reverse | CATCTCTTTTTCATTAAGTTTCAGTCGAAT |
| mAsPCR-seg36.6..Wild-Type | CCCGTCCGCTCGCTAAAT |
| mAsPCR-seg36.7..Recoded | TTCAGAATATTCGCTTTCTCAATATACCTCA |
| mAsPCR-seg36.7..Reverse | AATTCGAAACCTGCAGCATGG |
| mAsPCR-seg36.7..Wild-Type | TTCAGAATATTCGCTTAGCCAATATACCAGT |
| mAsPCR-seg36.8..Recoded | AACGTATTATCCATATCAGCTTTCCTCT |
| mAsPCR-seg36.8..Reverse | AGTGATGAGCGTGTCTGTAGC |
| mAsPCR-seg36.8..Wild-Type | AACGTATTATCCATATCAGTTGAGTAGC |
| mAsPCR-seg37.1..Recoded | TATCTAAAACTTTCCTCTAACGGCTATCTC |
| mAsPCR-seg37.1..Reverse | GACATCTTCGGCGGTGACT |
| mAsPCR-seg37.1..Wild-Type | TATCTAAAATTAAGCAGTAACGGCTATTTG |
| mAsPCR-seg37.2..Recoded | AACCTCCGTCACGCTATCAT |
| mAsPCR-seg37.2..Reverse | TACGCACTTTTCCGCCAGA |
| mAsPCR-seg37.2..Wild-Type | AACCTCCGTCACGCTAAGCA |
| mAsPCR-seg37.3..Recoded | GCGCATTCCTTTCCTGTTTTCA |
| mAsPCR-seg37.3..Reverse | CCAAACATTTCGGTAAACATCGGT |
| mAsPCR-seg37.3..Wild-Type | GCGCATTCCTTTCCTGTTTAGC |
| mAsPCR-seg37.4..Recoded | TAATTACCAACGCTCTTAAAACATCTGACG |
| mAsPCR-seg37.4..Reverse | GCTGTACGCGATTTATATTGGC |
| mAsPCR-seg37.4..Wild-Type | TAATTACCAACGCTCTTAAAACATCTGTCT |
| mAsPCR-seg37.5..Recoded | TGAAACACCCGCCGAAAAAC |
| mAsPCR-seg37.5..Reverse | ACCGCCCTGAGATGAATTAGTG |
| mAsPCR-seg37.5..Wild-Type | TGAAACACCCGCCGAAAAAT |
| mAsPCR-seg37.6..Recoded | GAACATAACTCTATTGCTGAGACTTTTAATC |
| mAsPCR-seg37.6..Reverse | GATTCCTAGCCCAAACATGCG |
| mAsPCR-seg37.6..Wild-Type | GAACATAACTCTATTGCTGAGACTTTTAATT |
| mAsPCR-seg37.7..Recoded | AGAGGGTTGTTTATTCTGATCACGA |
| mAsPCR-seg37.7..Reverse | CAGGCGCTCTCTCCACAG |

TABLE 4-continued

MASC primers (SEQ ID NOS 175-2262, respectively, in order of appearance) used for analysis of recoded segments.

| Primer | Sequence |
| --- | --- |
| mAsPCR-seg37.7..Wild-Type | AGAGGGTTGTTTATTCTGATCACGT |
| mAsPCR-seg37.8..Recoded | CGATGCTTCCTATTCGTCGTGATT |
| mAsPCR-seg37.8..Reverse | ACCACCCTGCCCTTTTTCTT |
| mAsPCR-seg37.8..Wild-Type | CGATGTTACCTATTCGTCGTGATA |
| mAsPCR-seg38.1..Recoded | CGAGCTGTAGTTGATAACCTGA |
| mAsPCR-seg38.1..Reverse | GCTTGATGAAGGCCGTCTTTC |
| mAsPCR-seg38.1..Wild-Type | CGAGCTGCAATTGATAACCGCT |
| mAsPCR-seg38.2..Recoded | CTATCAACTCTGGACGGCTCA |
| mAsPCR-seg38.2..Reverse | CGCCCGTTCTGAATGTGC |
| mAsPCR-seg38.2..Wild-Type | TTAAGTACTCTGGACGGCAGC |
| mAsPCR-seg38.3..Recoded | GCGGCTATCTGGATTATTGGCT |
| mAsPCR-seg38.3..Reverse | GTCATTTTCGCCATTACCGCTT |
| mAsPCR-seg38.3..Wild-Type | GCGGCTATCTGGATTATTGGCA |
| mAsPCR-seg38.4..Recoded | GGATACCATTCGCCTGACCTC |
| mAsPCR-seg38.4..Reverse | CGCAATCACATCCAGTTCGG |
| mAsPCR-seg38.4..Wild-Type | GGATACCATTCGCCTGACCAG |
| mAsPCR-seg38.5..Recoded | CGGCTCAAAAGGTACAGGACTT |
| mAsPCR-seg38.5..Reverse | GATTCACCACCTGTACCACAATTC |
| mAsPCR-seg38.5..Wild-Type | CGGCAGTAAAGGTACAGGTTTA |
| mAsPCR-seg38.6..Recoded | TCGGGTTTTCTGAGGTAAGTTTT |
| mAsPCR-seg38.6..Reverse | CACGTCGCCAGATTGAAGAAATT |
| mAsPCR-seg38.6..Wild-Type | TCGGGTTTTCGCTGGTCAATTTG |
| mAsPCR-seg38.7..Recoded | TCATCCCCTCAGCCATCCTT |
| mAsPCR-seg38.7..Reverse | GCCACGGTTCTGCTGATTG |
| mAsPCR-seg38.7..Wild-Type | TCATCCCCAGCGCCATCTTA |
| mAsPCR-seg38.8..Recoded | TCAATAGTTACCAGCGCGTTTGA |
| mAsPCR-seg38.8..Reverse | GCTTCGCGTGGGTGATATGTA |
| mAsPCR-seg38.8..Wild-Type | TCAATAGTTACCAGCGCGTTACT |
| mAsPCR-seg39.1..Recoded | GAGTCTTTCTTCCAGTATTCATCGAAAG |
| mAsPCR-seg39.1..Reverse | CACGAGGTCAACTTCATCTGC |
| mAsPCR-seg39.1..Wild-Type | GAGTCTTTCTTCCAGTATTCATCGAAGC |
| mAsPCR-seg39.2..Recoded | AGCCTGCCCGTTATTTCTCA |
| mAsPCR-seg39.2..Reverse | GTATGTTCCGGCCATTGTAGAATC |
| mAsPCR-seg39.2..Wild-Type | AGCCTGCCCGTTATTTCAGC |
| mAsPCR-seg39.3..Recoded | CGTTTTTATTCCCGCTCCTCA |
| mAsPCR-seg39.3..Reverse | CAATGCCAGAGCCAACGAC |
| mAsPCR-seg39.3..Wild-Type | CGTTTTTATTCCCGCAGCAGT |
| mAsPCR-seg39.4..Recoded | CAAACTATATGAAGCCAAAAACCGTCTT |

TABLE 4-continued

MASC primers (SEQ ID NOS 175-2262, respectively, in order of appearance) used for analysis of recoded segments.

| Primer | Sequence |
| --- | --- |
| mAsPCR-seg39.4..Reverse | CAGGGTAAACGCGGGAAGT |
| mAsPCR-seg39.4..Wild-Type | CAAATTGTATGAAGCCAAAAACCGTTTA |
| mAsPCR-seg39.5..Recoded | AAGATGTGAGTATGGGTCGTTAAAAAG |
| mAsPCR-seg39.5..Reverse | CAGCCACCTCCGATTCCT |
| mAsPCR-seg39.5..Wild-Type | CAAATGGCTGTATGGGTCGTTAAACAA |
| mAsPCR-seg39.6..Recoded | GCATCAGGGCCAGTGAAAAAG |
| mAsPCR-seg39.6..Reverse | TGCTCGCCCTAACCGTTATAC |
| mAsPCR-seg39.6..Wild-Type | GCATCAGGGCCAGGCTAAATAA |
| mAsPCR-seg39.7..Recoded | CGGTCGTATTTTCTCTGGCTCT |
| mAsPCR-seg39.7..Reverse | TCGGTCGATTGAGTGACAGC |
| mAsPCR-seg39.7..Wild-Type | CGGTCGTATTTTCAGTGGCAGC |
| mAsPCR-seg39.8..Recoded | GTGAGAATATTAGATAGGTTGAGCAGAGAA |
| mAsPCR-seg39.8..Reverse | CGTCTTGCATCACTTCACCTTTAAG |
| mAsPCR-seg39.8..Wild-Type | GTGAGAATATTACTTAAGTTCAACAGACTT |
| mAsPCR-seg40.1..Recoded | CCAGGGCCGCTTCTTTTGA |
| mAsPCR-seg40.1..Reverse | CCACCCATTGAGTGACCTGAA |
| mAsPCR-seg40.1..Wild-Type | CCAGGGCCGCTTCTTTACT |
| mAsPCR-seg40.2..Recoded | CGGTGTACGGAATAATCAGTGA |
| mAsPCR-seg40.2..Reverse | GGTTTACTTCCTGATGACCTCACT |
| mAsPCR-seg40.2..Wild-Type | CGGTGTACGGAATAATCAGGCT |
| mAsPCR-seg40.3..Recoded | AAACTCTGCGTCACCCTTTCC |
| mAsPCR-seg40.3..Reverse | CGCATTTTCGGCTATTTCGC |
| mAsPCR-seg40.3..Wild-Type | AAACTCTGCGTCACCTTAAGT |
| mAsPCR-seg40.4..Recoded | GTTCACAGTGTCCTTGCATTATCTTTGATT |
| mAsPCR-seg40.4..Reverse | TGCGGACGATCGGTAATACC |
| mAsPCR-seg40.4..Wild-Type | GTAGTCAGTGTCCTTGCATTATCTTTGATA |
| mAsPCR-seg40.5..Recoded | CTCAGGATTCGCCCATATCTCC |
| mAsPCR-seg40.5..Reverse | ATTTCCGGCATCATCAACGC |
| mAsPCR-seg40.5..Wild-Type | CTCAGGATTCGCCCATATCAGT |
| mAsPCR-seg40.6..Recoded | CGTAATCTTCCTGCCGTGACG |
| mAsPCR-seg40.6..Reverse | ACGTTTGTGCTGGTGAAAGATAAAA |
| mAsPCR-seg40.6..Wild-Type | CGTAATCTTCCTGCCGTGAAC |
| mAsPCR-seg40.7..Recoded | GTACAGACAGAAGAGAATGGACGA |
| mAsPCR-seg40.7..Reverse | GTTTGTGGGCTGCGTGTC |
| mAsPCR-seg40.7..Wild-Type | GTACAGACAGAAGAGAATGGAGCT |
| mAsPCR-seg40.8..Recoded | GCAGGGTAAGGGTGCTTC |
| mAsPCR-seg40.8..Reverse | GCTTTAACTTTGATTCTTTACCGTCAAC |

TABLE 4-continued

MASC primers (SEQ ID NOS 175-2262, respectively, in order of appearance) used for analysis of recoded segments.

| Primer | Sequence |
| --- | --- |
| mAsPCR-seg40.8..Wild-Type | GCAGGGTAAGGGTGCGAG |
| mAsPCR-seg41.1..Recoded | TGGACACTACTGCTGGCAATCT |
| mAsPCR-seg41.1..Reverse | GCACATCACGCTCAACTGAATAG |
| mAsPCR-seg41.1..Wild-Type | TGGACATTACTGCTGGCTCA |
| mAsPCR-seg41.2..Recoded | TATCCATAGCAGGTTTTGATGGTAAGA |
| mAsPCR-seg41.2..Reverse | GTGCGACCTGTCCGGATT |
| mAsPCR-seg41.2..Wild-Type | TATCCATAACAGGTTTTGATGGTAGCT |
| mAsPCR-seg41.3..Recoded | AATCTAACTTCTCGCTGCAACTCT |
| mAsPCR-seg41.3..Reverse | GCTTCAAAACGATCCTCTTCTGAAAG |
| mAsPCR-seg41.3..Wild-Type | AATCTAACTTCTCGCTGCAACTCA |
| mAsPCR-seg41.4..Recoded | TCGTCACCAGAAGCACAATGATAAG |
| mAsPCR-seg41.4..Reverse | TTTTTTTTACCCTTCTTTACACACTTTTCA |
| mAsPCR-seg41.4..Wild-Type | TCGTCACCAGTAACACAATGATCAA |
| mAsPCR-seg41.5..Recoded | CGTCTACTGGCAGATCAGCTA |
| mAsPCR-seg41.5..Reverse | CGGACACGCTCGGCATAA |
| mAsPCR-seg41.5..Wild-Type | CGTTTGCTGGCAGATCAGTTG |
| mAsPCR-seg41.6..Recoded | ACCGCACCATTGAACTCTCA |
| mAsPCR-seg41.6..Reverse | CGATTTCTTTGAGTACTACGGACAGATA |
| mAsPCR-seg41.6..Wild-Type | ACCGCACCATTGAACTCAGT |
| mAsPCR-seg41.7..Recoded | TAGTTTCAGTTTGCCCTTTTCAGA |
| mAsPCR-seg41.7..Reverse | CTTAATCGGGTTCTTCCAGTGC |
| mAsPCR-seg41.7..Wild-Type | CAATTTCAGTTTGCCCTTTTCGCT |
| mAsPCR-seg41.8..Recoded | TTGATAGATGAGATTTCCGTTTTGAA |
| mAsPCR-seg41.8..Reverse | AGCTCTTTTCGTCACTCCTTGA |
| mAsPCR-seg41.8..Wild-Type | TTGATGCTACTGATTTCCGTTTTGCTT |
| mAsPCR-seg42.1..Recoded | AGACACTTCTACGGTGCAACTTT |
| mAsPCR-seg42.1..Reverse | CGAAAGAAACCCTGCCGTCT |
| mAsPCR-seg42.1..Wild-Type | AGACACTTCTACGGTGCAACTTA |
| mAsPCR-seg42.2..Recoded | CCATTGCCCATCAGCGATTG |
| mAsPCR-seg42.2..Reverse | TCTTGAACGGCATAATAGGTTAGATAAATTG |
| mAsPCR-seg42.2..Wild-Type | CCATTGCCCATCAGCGATAC |
| mAsPCR-seg42.3..Recoded | CGCAGGAAGTGGAAGTCTCA |
| mAsPCR-seg42.3..Reverse | TTCTTGACCTGGAGAAATCACGT |
| mAsPCR-seg42.3..Wild-Type | CGCAGGAAGTGGAAGTCAGT |
| mAsPCR-seg42.4..Recoded | TGTTCCGCCAGATAGAAGAATCA |
| mAsPCR-seg42.4..Reverse | GTGGTTCTGGTAGATGTATTTCGAGA |
| mAsPCR-seg42.4..Wild-Type | TGTTCCGCCAGATAGAAGAAAGC |
| mAsPCR-seg42.5..Recoded | GACATCCAGCAGTCGAGCATTAG |

TABLE 4-continued

MASC primers (SEQ ID NOS 175-2262, respectively, in order of appearance) used for analysis of recoded segments.

| Primer | Sequence |
| --- | --- |
| mAsPCR-seg42.5..Reverse | CCTGTATTACTCCGGCTCTGG |
| mAsPCR-seg42.5..Wild-Type | CTCATCCAGCAGTCGAGCATTAA |
| mAsPCR-seg42.6..Recoded | TACTATCCAGGGCTCGCAACTT |
| mAsPCR-seg42.6..Reverse | TCGGAATGAATTGAGATATCGCCTT |
| mAsPCR-seg42.6..Wild-Type | TACTATGCAGGGCTCGCAATTA |
| mAsPCR-seg42.7..Recoded | GCAATCCATACCAGCACATAGGA |
| mAsPCR-seg42.7..Reverse | GCGCAACTATCCCTGGGT |
| mAsPCR-seg42.7..Wild-Type | GCAATCCATACCAGCACATAACT |
| mAsPCR-seg42.8..Recoded | GAATTTAGAGTCACGTTCACCACAA |
| mAsPCR-seg42.8..Reverse | TTGCCTCACTCAATGACGATCA |
| mAsPCR-seg42.8..Wild-Type | GAATTTGCTGTCACGTTCACCACAT |
| mAsPCR-seg43.1..Recoded | GTCTACCACTTATCCAGTCTTCGC |
| mAsPCR-seg43.1..Reverse | GTTATCCGGGGCATAGCGT |
| mAsPCR-seg43.1..Wild-Type | GTTTGCCACTTATCCAGTCTTCGT |
| mAsPCR-seg43.2..Recoded | GTGAAGCAGTGGTGATAACTAGAATAGA |
| mAsPCR-seg43.2..Reverse | TTGGTCAATATGAAAGCTTGATGGC |
| mAsPCR-seg43.2..Wild-Type | GTGAAGCAGTGGTGATAACTAAAATACT |
| mAsPCR-seg43.3..Recoded | GGATTGTGACCATCTCTGCAC |
| mAsPCR-seg43.3..Reverse | CCGTCTTTGGTTTCTGCTTTTTG |
| mAsPCR-seg43.3..Wild-Type | GGATTGTGACCATCTCTGCAT |
| mAsPCR-seg43.4..Recoded | CGGAAATATTTGATGGCAGACTGTAG |
| mAsPCR-seg43.4..Reverse | CGGTGGTATGCGTGATGGT |
| mAsPCR-seg43.4..Wild-Type | CGGAAATATTTGATGGCGCTCTGTAA |
| mAsPCR-seg43.5..Recoded | CCGCCAGGGGTAATAAATTCTGA |
| mAsPCR-seg43.5..Reverse | GCACGTCAGCATAATCTCATTATCTTC |
| mAsPCR-seg43.5..Wild-Type | CCGCCAGGGTAATAAATTCACT |
| mAsPCR-seg43.6..Recoded | GATAATTTGATTAATTTCGTTGGCAGAAAG |
| mAsPCR-seg43.6..Reverse | GCGCTTCATGTTTCCTGGTC |
| mAsPCR-seg43.6..Wild-Type | GATAATTTGATTAATTTCGTTGGCGCTCAA |
| mAsPCR-seg43.7..Recoded | CGGCTGACCCAGTACAAGGAG |
| mAsPCR-seg43.7..Reverse | TGGGAACGTATTTATCCGCTTGA |
| mAsPCR-seg43.7..Wild-Type | CGGCTGACCCAGTACTAACAA |
| mAsPCR-seg43.8..Recoded | CAGCAGAGTGAATAAGGATAAGGTGA |
| mAsPCR-seg43.8..Reverse | GGAGTGGGTTATATTTATGTAGTGATAGAGC |
| mAsPCR-seg43.8..Wild-Type | CAGCAGAGTGAATAAGGATAAGGACT |
| mAsPCR-seg44.1..Recoded | TATTTATGAAACGACTCATTGTAGGCATCT |
| mAsPCR-seg44.1..Reverse | ATAAGACGTTGCATTATTGTCCTGAAG |

TABLE 4-continued

MASC primers (SEQ ID NOS 175-2262, respectively, in order of appearance) used for analysis of recoded segments.

| Primer | Sequence |
| --- | --- |
| mAsPCR-seg44.1..Wild-Type | TATTTATGAAACGACTCATTGTAGGCATCA |
| mAsPCR-seg44.2..Recoded | GTGAAATCATTCTCGCCCAGTAG |
| mAsPCR-seg44.2..Reverse | GCTGCGTGCGTAATGACTAC |
| mAsPCR-seg44.2..Wild-Type | GTGAAATCATTCTCGCCCAGCAA |
| mAsPCR-seg44.3..Recoded | TGAGATAACCGTCATAGCACAGT |
| mAsPCR-seg44.3..Reverse | CGTTTACTTTTGCTCGTCGGTT |
| mAsPCR-seg44.3..Wild-Type | TGAGATAACCGTCATAGCACAGC |
| mAsPCR-seg44.4..Recoded | GAATAGCGTTGATGACATTGCAAG |
| mAsPCR-seg44.4..Reverse | GATCTCATTATCGACGACATCAACG |
| mAsPCR-seg44.4..Wild-Type | GAATAACGTGCTACTCATTGCCAA |
| mAsPCR-seg44.5..Recoded | GTATGCTGGTGAAGATGACGTTTC |
| mAsPCR-seg44.5..Reverse | GTCATCGCCGCCATTTTCTT |
| mAsPCR-seg44.5..Wild-Type | GTATGCTGGTGAAGATGACGTTAG |
| mAsPCR-seg44.6..Recoded | GTCTTCCTGAAGTACAACTTGGAC |
| mAsPCR-seg44.6..Reverse | CAGCAGCGCACGACCAAG |
| mAsPCR-seg44.6..Wild-Type | GTTTGCCTGAAGTACAACTTGGAT |
| mAsPCR-seg44.7..Recoded | ACCTTTATCTTCGCGCTTATGTCA |
| mAsPCR-seg44.7..Reverse | ATCCATTTAACTAAGAGGACAATGCG |
| mAsPCR-seg44.7..Wild-Type | ACCTTTATCTTCGCGTTAATGAGT |
| mAsPCR-seg44.8..Recoded | TTTCTCCGGAGTTTAAACAGTTCTTTTCA |
| mAsPCR-seg44.8..Reverse | CCATGTGAGCGCAGTTTCG |
| mAsPCR-seg44.8..Wild-Type | TTTCTCCGGAGTTTAAACAGTTCTTTAGC |
| mAsPCR-seg45.1..Recoded | GCATCAAAATCGATCGCACTATCA |
| mAsPCR-seg45.1..Reverse | CTTTTTCACGTTCGTTAGCCTGT |
| mAsPCR-seg45.1..Wild-Type | GCAAGCAAATCGATCGCATTAAGT |
| mAsPCR-seg45.2..Recoded | TGACTTCGGGCATGGTAGG |
| mAsPCR-seg45.2..Reverse | AAAATTTCGAGGTTATTAATCATGTCAGATC |
| mAsPCR-seg45.2..Wild-Type | TGACTTCGGGCATGGCAAT |
| mAsPCR-seg45.3..Recoded | GCTGTTTCGCCATGTCAATTCT |
| mAsPCR-seg45.3..Reverse | CGGATTCAGACGGATTGACGA |
| mAsPCR-seg45.3..Wild-Type | GCTGTTTCGCCATGTCAATAGC |
| mAsPCR-seg45.4..Recoded | TGAAGATCTTACCCCATCACAGTTTC |
| mAsPCR-seg45.4..Reverse | GGAACAGCCCGACACCTT |
| mAsPCR-seg45.4..Wild-Type | TGAAGATTTAACCCCAAGCCAGTTTT |
| mAsPCR-seg45.5..Recoded | CGTCGGCTGGGTAGACATTAG |
| mAsPCR-seg45.5..Reverse | TGATGTCAGGGATTTCACGCA |
| mAsPCR-seg45.5..Wild-Type | CGTCGGCTGGGTAGACATCAA |
| mAsPCR-seg45.6..Recoded | CACGACCCCCAGATAAAATATTGAAG |

TABLE 4-continued

MASC primers (SEQ ID NOS 175-2262, respectively, in order of appearance) used for analysis of recoded segments.

| Primer | Sequence |
| --- | --- |
| mAsPCR-seg45.6..Reverse | CCTTAAAGTCTTGCTGTATCCG |
| mAsPCR-seg45.6..Wild-Type | CAGCTCCCCCAGATAAAATATTGCAA |
| mAsPCR-seg45.7..Recoded | TTATCAACGCGGAAGAGATTGACT |
| mAsPCR-seg45.7..Reverse | ATGACTTCAATGCCCAGTTCCT |
| mAsPCR-seg45.7..Wild-Type | TTATCAACGCGGAAGAGATTGACA |
| mAsPCR-seg45.8..Recoded | GCGCTAAAACTACAAGAAGATGAATCA |
| mAsPCR-seg45.8..Reverse | AAGGTGCTTTTTTACGCATTTTTAACA |
| mAsPCR-seg45.8..Wild-Type | GCGTTGAAACTACAAGAAGATGAAAGC |
| mAsPCR-seg46.1..Recoded | GTATTGCCTATTGTTTGTTCTAGTGTGGA |
| mAsPCR-seg46.1..Reverse | TGAAGAACTAAAATTCACCTCCGTT |
| mAsPCR-seg46.1..Wild-Type | GTATTGCCTATTGTTTGTTCTAATGTACT |
| mAsPCR-seg46.2..Recoded | AACAATCGCCGCTTTCGTAAG |
| mAsPCR-seg46.2..Reverse | ACAACGCCTGAAATGATGCATAAA |
| mAsPCR-seg46.2..Wild-Type | AACAATCGCCGCTTTCGTTAA |
| mAsPCR-seg46.3..Recoded | TACCTCAGCGACAAGAAAAAGCG |
| mAsPCR-seg46.3..Reverse | TTCGGCTTTGAGTGTCCGT |
| mAsPCR-seg46.3..Wild-Type | TACCTCAGCGACCAAAAACAAAC |
| mAsPCR-seg46.4..Recoded | GCAGAAATCAGACCGAGTGA |
| mAsPCR-seg46.4..Reverse | GTTATGGTCGCGTGAAGATTGAAG |
| mAsPCR-seg46.4..Wild-Type | GCAGAAATCAGACCGAGGCT |
| mAsPCR-seg46.5..Recoded | GTTGTTCATATTCAGTACTTTACCGACTG |
| mAsPCR-seg46.5..Reverse | CGCTGGGGCTGAAATTCATC |
| mAsPCR-seg46.5..Wild-Type | GTTGTTCATATTCAGTACTTTACCGACGC |
| mAsPCR-seg46.6..Recoded | CAACCGTAATTAACAACGCCATCT |
| mAsPCR-seg46.6..Reverse | AATCAGACGTTTATTGGTGTGTTTACG |
| mAsPCR-seg46.6..Wild-Type | CAACCGTAATTAACAACGCCATCA |
| mAsPCR-seg46.7..Recoded | CCGAACAAATCCTCGCCCTT |
| mAsPCR-seg46.7..Reverse | GAACAGACGAATGCCTTCAGAC |
| mAsPCR-seg46.7..Wild-Type | CCGAACAAATCCTCGCCTTA |
| mAsPCR-seg46.8..Recoded | CGATGTGCATTGAGTTGTGGTG |
| mAsPCR-seg46.8..Reverse | CTTTTTTTACATTGTGCTGCTGTCG |
| mAsPCR-seg46.8..Wild-Type | CGATGTGCATTGAGTTGTGGAC |
| mAsPCR-seg47.1..Recoded | TTACACCTCATGGAAAAATTGCTGATAT |
| mAsPCR-seg47.1..Reverse | AACCTCTCTTATAATTATGGGTATTCTACGG |
| mAsPCR-seg47.1..Wild-Type | CTACACCTCATGGAAAAATTGCTGATAA |
| mAsPCR-seg47.2..Recoded | GTCAAAAACCAGTGCCTCAGA |
| mAsPCR-seg47.2..Reverse | CCGCATTTTGTCCAGCATCTC |

TABLE 4-continued

MASC primers (SEQ ID NOS 175-2262, respectively, in order of appearance) used for analysis of recoded segments.

| Primer | Sequence |
| --- | --- |
| mAsPCR-seg47.2...Wild-Type | GTCAAAAACCAGTGCCTCGCT |
| mAsPCR-seg47.3...Recoded | TATCTTCGGTGCCAGCCATGA |
| mAsPCR-seg47.3...Reverse | CGGTCTGTCACTGCACGA |
| mAsPCR-seg47.3...Wild-Type | TATCTTCGGTGCCAGCCAACT |
| mAsPCR-seg47.4...Recoded | CAGCAGCAGTGTGATCCCTAG |
| mAsPCR-seg47.4...Reverse | CGGTAGCGCTAGGTCATTTTCT |
| mAsPCR-seg47.4...Wild-Type | CAGCAGCAGTGTGATCCCTAA |
| mAsPCR-seg47.5...Recoded | AGATTGGCGGTAATAAAATGCGAT |
| mAsPCR-seg47.5...Reverse | GGAGTCGCGGTTCTACACTG |
| mAsPCR-seg47.5...Wild-Type | AGATTGGCGGTAATAAAATGGCTG |
| mAsPCR-seg47.6...Recoded | CTGACGACGAAACCTTTGCAT |
| mAsPCR-seg47.6...Reverse | GTCGATACAGACCAGCGATAGAT |
| mAsPCR-seg47.6...Wild-Type | CTGACGACGAAACCTTTGCAA |
| mAsPCR-seg47.7...Recoded | CTGTTCCTGATTAAAACCCGGAAG |
| mAsPCR-seg47.7...Reverse | ACCAGTATCACATCGACTCAGAAC |
| mAsPCR-seg47.7...Wild-Type | CTGTTCCTGATTAAAACCCGGCAA |
| mAsPCR-seg47.8...Recoded | GGGTTCTATGGTGAATGATAAAACCCTT |
| mAsPCR-seg47.8...Reverse | CAGGACATTTGGTATTTGGCTGAA |
| mAsPCR-seg47.8...Wild-Type | GGGTTCTATGGTGAATGATAAAACCTTA |
| mAsPCR-seg48.1...Recoded | TAATCCAGTGCAGATAACCTTCAGA |
| mAsPCR-seg48.1...Reverse | AGAGCCTGCACTTCTTCTGG |
| mAsPCR-seg48.1...Wild-Type | TAATCCAGTGCAGATAACCTTCACT |
| mAsPCR-seg48.2...Recoded | CACTGATGCTACCGGTAAAAAACTT |
| mAsPCR-seg48.2...Reverse | CGCACAGTCAACCACCATG |
| mAsPCR-seg48.2...Wild-Type | CACTGATGCTACCGGTAAAAAATTG |
| mAsPCR-seg48.3...Recoded | CGGCAGATGACTTCGGTTCA |
| mAsPCR-seg48.3...Reverse | TCTTTGATATAACGTGCGATGTTCAG |
| mAsPCR-seg48.3...Wild-Type | CGGCAGATGACTTCGGTAGC |
| mAsPCR-seg48.4...Recoded | CGTGGCGATGCGTGAACTT |
| mAsPCR-seg48.4...Reverse | CATCCAGTTCATCGGTCGTTTTTAG |
| mAsPCR-seg48.4...Wild-Type | CGTGGCGATGCGTGAATTA |
| mAsPCR-seg48.5...Recoded | CGACCGATGGATTTACGAACAAG |
| mAsPCR-seg48.5...Reverse | GTCTGTGGAACGGCATCAAA |
| mAsPCR-seg48.5...Wild-Type | CGACCGATGGATTTACGAACTAA |
| mAsPCR-seg48.6...Recoded | GAACATGCGTGACGAGCTATC |
| mAsPCR-seg48.6...Reverse | CGGCACTAGATAAACGCAGG |
| mAsPCR-seg48.6...Wild-Type | GAACATGCGTGACGAGTTAAG |
| mAsPCR-seg48.7...Recoded | TCAGCGTTGATCATCACACCA |

TABLE 4-continued

MASC primers (SEQ ID NOS 175-2262, respectively, in order of appearance) used for analysis of recoded segments.

| Primer | Sequence |
| --- | --- |
| mAsPCR-seg48.7..Reverse | GTCGGCCCGTGTGGTATG |
| mAsPCR-seg48.7..Wild-Type | TCAGCGTTGATCATCACACCG |
| mAsPCR-seg48.8..Recoded | GTGTTGATGATAGATATAGTGGACATCTG |
| mAsPCR-seg48.8..Reverse | GTTAATGAGGGATTTATGAAAACGATGC |
| mAsPCR-seg48.8..Wild-Type | GTGTTGATGATAGATATAGTGGACATCGC |
| mAsPCR-seg49.1..Recoded | CCAAATTCTGAGTGTCCCCATGA |
| mAsPCR-seg49.1..Reverse | GCGGTGTGGTGGCTGGAAAAC |
| mAsPCR-seg49.1..Wild-Type | CCAAATTCACTGTGTCCCCAACT |
| mAsPCR-seg49.2..Recoded | GGGCGTTCTCTGGGCAATT |
| mAsPCR-seg49.2..Reverse | AAGATCATGGCGCGTTCCT |
| mAsPCR-seg49.2..Wild-Type | GGGCGTTCTCTGGGCAATA |
| mAsPCR-seg49.3..Recoded | CGCACCCAGTTCTTCGTTAAATAG |
| mAsPCR-seg49.3..Reverse | GCCTGTATGAAGCCGTTAAAGC |
| mAsPCR-seg49.3..Wild-Type | CGCACCCAGTTCTTCGTTAAACAA |
| mAsPCR-seg49.4..Recoded | CAGGGGCTTGCCCAGTCA |
| mAsPCR-seg49.4..Reverse | GTTTTGCGCCACCAGACC |
| mAsPCR-seg49.4..Wild-Type | CAGGGGCTTGCCCAGAGT |
| mAsPCR-seg49.5..Recoded | CGACAACCGCGACAACTC |
| mAsPCR-seg49.5..Reverse | GGGACCAACGCTGTTTCG |
| mAsPCR-seg49.5..Wild-Type | CGACAACCGCGACAACAG |
| mAsPCR-seg49.6..Recoded | GGTCCGTTAGCTGCTCTGA |
| mAsPCR-seg49.6..Reverse | GAGGATTAGGTGGTGAAATAAAAGGC |
| mAsPCR-seg49.6..Wild-Type | GGTCCGTTAACTGCTCGCT |
| mAsPCR-seg49.7..Recoded | GCAGCGGTACACCTTCTTTCA |
| mAsPCR-seg49.7..Reverse | ACCCATGATAGCGCCTGTG |
| mAsPCR-seg49.7..Wild-Type | GCAGCGGTACACCTTTTGAGT |
| mAsPCR-seg49.8..Recoded | TCTGCGGTATTGGAAGTCAGATTC |
| mAsPCR-seg49.8..Reverse | GAGGCACGACGTCTTTTCT |
| mAsPCR-seg49.8..Wild-Type | TCTGCGGTATTGGAAGTCAGATTG |
| mAsPCR-seg50.1..Recoded | GTTTGGACTAATGTTCTCTGTCTCACTA |
| mAsPCR-seg50.1..Reverse | CAATCGCCGTGCATTCATCAT |
| mAsPCR-seg50.1..Wild-Type | GTTTGGATTGATGTTCTCTGTCAGTTTG |
| mAsPCR-seg50.2..Recoded | GACCATCGCCTCGTCTGA |
| mAsPCR-seg50.2..Reverse | GGAACAACAGGCGCTTATGAAA |
| mAsPCR-seg50.2..Wild-Type | GACCATCGCCTCGTCGCT |
| mAsPCR-seg50.3..Recoded | CGCTAACTATCGACCATTGTCTACTA |
| mAsPCR-seg50.3..Reverse | CTTTTTGCATTTCCGCTGATTCAAG |

TABLE 4-continued

MASC primers (SEQ ID NOS 175-2262, respectively, in order of appearance) used for analysis of recoded segments.

| Primer | Sequence |
| --- | --- |
| mAsPCR-seg50.3..Wild-Type | CGTTAACTATCGACCATTGTTTGTTG |
| mAsPCR-seg50.4..Recoded | ACCGATAACTATGGTGAAGACTCC |
| mAsPCR-seg50.4..Reverse | TTCCAGACTCACTCTCCGGTA |
| mAsPCR-seg50.4..Wild-Type | ACCGATAACTATGGTGAAGACAGT |
| mAsPCR-seg50.5..Recoded | CTCAGGCGTTTTCTGTTCTTTTGATGA |
| mAsPCR-seg50.5..Reverse | TGCCAGTTTTCACATTCTTCAGTT |
| mAsPCR-seg50.5..Wild-Type | CTCAGGCGTTTTCTGTTCTTTACTACT |
| mAsPCR-seg50.6..Recoded | CGAACTAATTGGCATGGACTCT |
| mAsPCR-seg50.6..Reverse | TTTCTTGTGAGTCGGCCTGAT |
| mAsPCR-seg50.6..Wild-Type | CGAATTGATTGGCATGGACAGC |
| mAsPCR-seg50.7..Recoded | CCAGCCTTTATGCAGCGTCTT |
| mAsPCR-seg50.7..Reverse | CGACGGCATCCATTACTTCC |
| mAsPCR-seg50.7..Wild-Type | CCAGCCTTTATGCAGCGTTTA |
| mAsPCR-seg50.8..Recoded | GGAAGTTTTACACCTCATATACGCTT |
| mAsPCR-seg50.8..Reverse | AGGAATGTTGGCGTGGCT |
| mAsPCR-seg50.8..Wild-Type | GGAAGTTTTACACCAGCTATACGTTG |
| mAsPCR-seg51.1..Recoded | CCCGGCTTCAGTTCGTTAG |
| mAsPCR-seg51.1..Reverse | CCCATTCATTAAGTAACTCTGCACTTG |
| mAsPCR-seg51.1..Wild-Type | CCCGGCTTCAGTTCGTTAC |
| mAsPCR-seg51.2..Recoded | GTGTAACCGTAGACCTCCTGA |
| mAsPCR-seg51.2..Reverse | GTGGGCGTGTGGTGTCTC |
| mAsPCR-seg51.2..Wild-Type | GTGTAACCGTAGACCTCCTGC |
| mAsPCR-seg51.3..Recoded | AACTGATTGGTATGGTCGCTCAA |
| mAsPCR-seg51.3..Reverse | GCTTAGATCTCTTCACGGT |
| mAsPCR-seg51.3..Wild-Type | AACTGATTGGTATGGTCGCTCAG |
| mAsPCR-seg51.4..Recoded | CTGCCCAACCTGTTCGGAAAG |
| mAsPCR-seg51.4..Reverse | CAAAACTAAGTACTCTATTTCGCAGCTT |
| mAsPCR-seg51.4..Wild-Type | CTGCCCAACCTGTTCACTTAA |
| mAsPCR-seg51.5..Recoded | GCATCGCATCCATCACTGA |
| mAsPCR-seg51.5..Reverse | GAAGATAAATCTATCGCGCTGCTG |
| mAsPCR-seg51.5..Wild-Type | GCATCGCATCCATCACGCT |
| mAsPCR-seg51.6..Recoded | AAGCACCATTATCGGCTGTGA |
| mAsPCR-seg51.6..Reverse | GTCGGCGAAGTCAACTCAGA |
| mAsPCR-seg51.6..Wild-Type | AAGCACCATTATCGGCTGACT |
| mAsPCR-seg51.7..Recoded | CGAGGTCAGTTTCAACCGTAAG |
| mAsPCR-seg51.7..Reverse | CGTAAAAACTCGCCGCTGAAATA |
| mAsPCR-seg51.7..Wild-Type | CGAGGTCAGTTTCAACCGTTAA |
| mAsPCR-seg51.8..Recoded | CTATTGAAAACAATGTGCCGGTGAATC |

TABLE 4-continued

MASC primers (SEQ ID NOS 175-2262, respectively, in order of appearance) used for analysis of recoded segments.

| Primer | Sequence |
| --- | --- |
| mAsPCR-seg51.8..Reverse | CATTCCTCAGGTGATTGTCATTTTTGA |
| mAsPCR-seg51.8..Wild-Type | CTATTGAAAACAATGTGCCGGTGAATT |
| mAsPCR-seg52.1..Recoded | ATTACGCTTATCCCGACGCTT |
| mAsPCR-seg52.1..Reverse | AGACGTGCCTGATCTTCCTG |
| mAsPCR-seg52.1..Wild-Type | ATTAGGCTTATCCCGACGTTG |
| mAsPCR-seg52.2..Recoded | CCCGCATCCAGATAGATACAAGA |
| mAsPCR-seg52.2..Reverse | GCAGGCATTTGAGTTCAGGTC |
| mAsPCR-seg52.2..Wild-Type | CCCGCATCCAGATAGATACAACT |
| mAsPCR-seg52.3..Recoded | GTTTGCAGGATTTCGCGTAG |
| mAsPCR-seg52.3..Reverse | CTCAACATACGCAACCTGGTG |
| mAsPCR-seg52.3..Wild-Type | GTTTGCAGGATTTCGCGCAA |
| mAsPCR-seg52.4..Recoded | AGAGGAAGTTGTGCAAAACGTG |
| mAsPCR-seg52.4..Reverse | AGCAAGCTACAAACGCGAAAC |
| mAsPCR-seg52.4..Wild-Type | AGAGGAAGTTGTGCAAAACGGC |
| mAsPCR-seg52.5..Recoded | GCAGACGACCAATCAGAGTTGA |
| mAsPCR-seg52.5..Reverse | CGGATGGTGCGTTTCCGGA |
| mAsPCR-seg52.5..Wild-Type | GCAGACGACCAATCAGAGTACT |
| mAsPCR-seg52.6..Recoded | CAAGGACTGTATGGTAATCACGAAG |
| mAsPCR-seg52.6..Reverse | CGTGAACATGCGATCTTATCTTATCC |
| mAsPCR-seg52.6..Wild-Type | CAAGGACTGTATGGTAATCACGCAA |
| mAsPCR-seg52.7..Recoded | ATCGCTTATTTGATACAAGTCCTGAAAG |
| mAsPCR-seg52.7..Reverse | GCGGGGCTTTCTATAAACGAT |
| mAsPCR-seg52.7..Wild-Type | ATCGCTTATTTGATACAAGTCCACTCAA |
| mAsPCR-seg52.8..Recoded | CCAGTTGCTCCGGGTTAAG |
| mAsPCR-seg52.8..Reverse | TATCGCTATCCCGTCTTTAATCCAC |
| mAsPCR-seg52.8..Wild-Type | CCAGTTGCTCCGGGTTCAA |
| mAsPCR-seg53.1..Recoded | AAAGTGAACAGATATTAATAATTTTGCCTGA |
| mAsPCR-seg53.1..Reverse | TTTCAGGTGGATTACTTTTCTCAGGT |
| mAsPCR-seg53.1..Wild-Type | ACAATGAACAGATATTAATAATTTTGCCGCT |
| mAsPCR-seg53.2..Recoded | GATATGATCGGCTTGATTCCTCA |
| mAsPCR-seg53.2..Reverse | AGTTAAAGTTTTTATTATGTTCCCTGCATCA |
| mAsPCR-seg53.2..Wild-Type | GATTATGATCGGCTTTGATTCCAGC |
| mAsPCR-seg53.3..Recoded | GCGTGGTAGCTAATGATCGTT |
| mAsPCR-seg53.3..Reverse | GCTCTCCCCAGTCGATATTCTC |
| mAsPCR-seg53.3..Wild-Type | GCGTGGTAGCTAATGATCGTA |
| mAsPCR-seg53.4..Recoded | GCAATGCACGCTGGATATTCTTTC |
| mAsPCR-seg53.4..Reverse | CATGTTGCACCATATCTTCCAGGA |

TABLE 4-continued

MASC primers (SEQ ID NOS 175-2262, respectively, in order of appearance) used for analysis of recoded segments.

| Primer | Sequence |
| --- | --- |
| mAsPCR-seg53.4..Wild-Type | GCAATGCACGCTGGATATTTTAAG |
| mAsPCR-seg53.5..Recoded | GCAAACAGTTCGATGCCCTA |
| mAsPCR-seg53.5..Reverse | AAAACAAGAACAAGAAAGGAAGGGTT |
| mAsPCR-seg53.5..Wild-Type | GCAAACAGTTCGATGCCTTC |
| mAsPCR-seg53.6..Recoded | TAAGTGAAGAGAGAAATTAGTGGACGATC |
| mAsPCR-seg53.6..Reverse | GTCGTATAAAAGGTATGAATTGTGGGTT |
| mAsPCR-seg53.6..Wild-Type | TAAGTGAAGAGAGAAATTAGTGGACGATT |
| mAsPCR-seg53.7..Recoded | GTTTCCATATGGCAGCCTATCAAT |
| mAsPCR-seg53.7..Reverse | AGTTGCCTTACGATTTTTGAGAGC |
| mAsPCR-seg53.7..Wild-Type | GTTTCCATATGGCAGCCTATCAAA |
| mAsPCR-seg53.8..Recoded | CCATCTCTGCCAGCACTTTTAG |
| mAsPCR-seg53.8..Reverse | TTCGGTTGGTATGGCGTAGG |
| mAsPCR-seg53.8..Wild-Type | CCATCTCTGCCAGCACTTTCAA |
| mAsPCR-seg54.1..Recoded | CTTCCGCCAGCGTTGCTAG |
| mAsPCR-seg54.1..Reverse | CGAGAGAAAGTGGCGCAAC |
| mAsPCR-seg54.1..Wild-Type | CTTCCGCCAGCGTTGCTAA |
| mAsPCR-seg54.2..Recoded | TTAATGATATCGGGCTACTACACTCA |
| mAsPCR-seg54.2..Reverse | GAAGAAAGCGCACCGTACC |
| mAsPCR-seg54.2..Wild-Type | TTAATGATATCGGGTTGTTGCACAGC |
| mAsPCR-seg54.3..Recoded | CGTGATAGCATGTCATCAAAACCAAG |
| mAsPCR-seg54.3..Reverse | GGTCGTCTTTGAAACCTGGAAAG |
| mAsPCR-seg54.3..Wild-Type | CGACTTAACATGTCATCAAAACCCAA |
| mAsPCR-seg54.4..Recoded | GCTATGGCGATCTCATCTGTAC |
| mAsPCR-seg54.4..Reverse | CATCCTGACGTACGACCTGAAA |
| mAsPCR-seg54.4..Wild-Type | GCTATGGCGATCAGTAGCGTAT |
| mAsPCR-seg54.5..Recoded | CGCGAAAGTCCTACTTCTTCAAATAG |
| mAsPCR-seg54.5..Reverse | ATCCACCCCTTCCTCTGTTTATAA |
| mAsPCR-seg54.5..Wild-Type | CGGCTTAATCCTACTTCTTCAAACAA |
| mAsPCR-seg54.6..Recoded | CTTATTATCGCCTCCAAAGTGTCA |
| mAsPCR-seg54.6..Reverse | CGCGTTGGTACTCTGCCA |
| mAsPCR-seg54.6..Wild-Type | TTAATTATCGCCTCCAAAGTGAGC |
| mAsPCR-seg54.7..Recoded | GGCGAACCAGACGAATCG |
| mAsPCR-seg54.7..Reverse | GGTAACGCACGGTGGTCA |
| mAsPCR-seg54.7..Wild-Type | GGCGAACCAGACGAAAGC |
| mAsPCR-seg54.8..Recoded | TGCCTGAGACATGAAGAATACTGA |
| mAsPCR-seg54.8..Reverse | TCTGCGAAAGATTGATGGTATTCC |
| mAsPCR-seg54.8..Wild-Type | TGCCTGAGACATGAAGAATACGCT |
| mAsPCR-seg55.1..Recoded | GAATATGCGCCTATGACAAATGCT |

TABLE 4-continued

MASC primers (SEQ ID NOS 175-2262, respectively, in order of appearance) used for analysis of recoded segments.

| Primer | Sequence |
| --- | --- |
| mAsPCR-seg55.1..Reverse | ATCACACGAGAAGTTCAGAAGCAT |
| mAsPCR-seg55.1..Wild-Type | GAATATGCGCCTATGACAAATGCG |
| mAsPCR-seg55.2..Recoded | TCCAATCGGTATCAATAATCTATCTCAATCA |
| mAsPCR-seg55.2..Reverse | AATCTCGGTTCCTATTTTAATGTTCAGAC |
| mAsPCR-seg55.2..Wild-Type | TCCAATCGGTATCAATAATTTATCTCAAAGT |
| mAsPCR-seg55.3..Recoded | GATAACGGCAATTTCTCGGAACTT |
| mAsPCR-seg55.3..Reverse | CCTTTCGCTTCACCTTCCAG |
| mAsPCR-seg55.3..Wild-Type | GATAACGGCAATTTCAGCGAATTA |
| mAsPCR-seg55.4..Recoded | TATCACCCGCAACGTCAATCA |
| mAsPCR-seg55.4..Reverse | GTGGCCGATATAACCGAGAAC |
| mAsPCR-seg55.4..Wild-Type | TATCACCCGCAACGTCAAAGC |
| mAsPCR-seg55.5..Recoded | GGCTACAACCATCACCTTTCG |
| mAsPCR-seg55.5..Reverse | CACTGAGTGAACTGAGCCTGA |
| mAsPCR-seg55.5..Wild-Type | GGCTACAACCATCACCTTAGC |
| mAsPCR-seg55.6..Recoded | AAAATACTTCCAGCCTCTATTTATGTACTT |
| mAsPCR-seg55.6..Reverse | CAATAAACCGCAGCGCAGAG |
| mAsPCR-seg55.6..Wild-Type | AAAATATTGCCAGCCTCTATTTATGTATTA |
| mAsPCR-seg55.7..Recoded | CGAAAGGAGAAACACTGATGTCA |
| mAsPCR-seg55.7..Reverse | AAGAGATCCGACGAAATGAGCAT |
| mAsPCR-seg55.7..Wild-Type | CGAAAGGAGAAACACTGATGAGC |
| mAsPCR-seg55.8..Recoded | TCCCTGGATCAATTTATCGAAGCAT |
| mAsPCR-seg55.8..Reverse | GAAATCGTTCGGGAAGGCAATC |
| mAsPCR-seg55.8..Wild-Type | AGCCTGGATCAATTTATCGAAGCAA |
| mAsPCR-seg56.1..Recoded | AACTGTATGAGCGTTATCAGCGA |
| mAsPCR-seg56.1..Reverse | CCTCACGGCTAGGTTCGC |
| mAsPCR-seg56.1..Wild-Type | AACTGTATGAGCGTTATCAGAGG |
| mAsPCR-seg56.2..Recoded | GCAGCCATTCGTGTTCTTTTGA |
| mAsPCR-seg56.2..Reverse | CGATCTGTTTATTGCCACCACTG |
| mAsPCR-seg56.2..Wild-Type | GCAGCCATTCGTGTTCTTTGCT |
| mAsPCR-seg56.3..Recoded | TCCAGTCCTAGCCAGTGTGA |
| mAsPCR-seg56.3..Reverse | GGGAGAAATCACCGCCATG |
| mAsPCR-seg56.3..Wild-Type | TCCAGTCCTAACCAGTGGCT |
| mAsPCR-seg56.4..Recoded | TGTTTACAGGCAAATTGAGGTAGTAG |
| mAsPCR-seg56.4..Reverse | CAGTTTTTGCCCTTGTTCCGT |
| mAsPCR-seg56.4..Wild-Type | TGTTTACAGGCAAATTGAGGCAATAA |
| mAsPCR-seg56.5..Recoded | TATTTTTCCATCAGATAGCGCTTAGGA |
| mAsPCR-seg56.5..Reverse | GGAAAATTATCGCCACCATGCTT |

TABLE 4-continued

MASC primers (SEQ ID NOS 175-2262, respectively, in order of appearance) used for analysis of recoded segments.

| Primer | Sequence |
| --- | --- |
| mAsPCR-seg56.5...Wild-Type | TATTTTTCCATCAGATAGCGCCTAACT |
| mAsPCR-seg56.6...Recoded | GGTTTCTTCACCGTCACTGA |
| mAsPCR-seg56.6...Reverse | GCATAATTCCCGTCATCAAACTTCTAG |
| mAsPCR-seg56.6...Wild-Type | GGTTTCTTCACCGTCACGCT |
| mAsPCR-seg56.7...Recoded | TTGCCGCCAAAATATTCGTATGA |
| mAsPCR-seg56.7...Reverse | GCGCTACTCGGTTCGGAA |
| mAsPCR-seg56.7...Wild-Type | TTGCCGCCAAAATATTCGTAGCT |
| mAsPCR-seg56.8...Recoded | GCTTTTCAGGCTTACTCGCTTTCC |
| mAsPCR-seg56.8...Reverse | CTGACCGTTGATATTGTTGCCT |
| mAsPCR-seg56.8...Wild-Type | GCTTTTCAGGCTTACAGTTTGAGT |
| mAsPCR-seg57.1...Recoded | AAATCGATCGAACTCGGTGTATCA |
| mAsPCR-seg57.1...Reverse | GTCTTTACGCATCAGGATCACATC |
| mAsPCR-seg57.1...Wild-Type | AAATCGATCGAACTCGGTGTAAGC |
| mAsPCR-seg57.2...Recoded | GGTTAAACTTCCTCCGCTGTCA |
| mAsPCR-seg57.2...Reverse | CGCGAACCAAACAGCGTATT |
| mAsPCR-seg57.2...Wild-Type | GGTTAAATTACCTCCGCTGAGT |
| mAsPCR-seg57.3...Recoded | CCGCACTGGTTATGGGTTTTT |
| mAsPCR-seg57.3...Reverse | GTCACGGCCATCAAGCAC |
| mAsPCR-seg57.3...Wild-Type | CCGCACTGGTTATGGGTTTTA |
| mAsPCR-seg57.4...Recoded | CTAAACAGCAAGCGAATCAGTCA |
| mAsPCR-seg57.4...Reverse | CAGAGATGTTGAAGAAGTCGAATGC |
| mAsPCR-seg57.4...Wild-Type | CTAAACAGCAAGCGAATCAGAGC |
| mAsPCR-seg57.5...Recoded | TCCAGACGGAAGATACTGAATACT |
| mAsPCR-seg57.5...Reverse | CAGAGGATTTTCGGGATGTCG |
| mAsPCR-seg57.5...Wild-Type | TCCAGACGGAAGATACTGAATACA |
| mAsPCR-seg57.6...Recoded | TGTTAAGCTGACCAACACCATCT |
| mAsPCR-seg57.6...Reverse | GCCACCAGCGAATAGGTCA |
| mAsPCR-seg57.6...Wild-Type | TGTTAAGCTGACCAACACCATCA |
| mAsPCR-seg57.7...Recoded | CGTCGGTACTTATTGGTGCCT |
| mAsPCR-seg57.7...Reverse | GGGCTATCTTGACCGACTGAC |
| mAsPCR-seg57.7...Wild-Type | CGTCGGTATTGATTGGTGCCA |
| mAsPCR-seg57.8...Recoded | GCGAACTATCTGGATAACTTCTCCCTT |
| mAsPCR-seg57.8...Reverse | TCGACATCTTCCAGACCAATATGC |
| mAsPCR-seg57.8...Wild-Type | GCGAACTATCTGGATAACTTCAGTTTA |
| mAsPCR-seg58.1...Recoded | CCGGCTTCATCATCTTCGAAAG |
| mAsPCR-seg58.1...Reverse | CGAGAAAGTGAAGGGCGATAAAG |
| mAsPCR-seg58.1...Wild-Type | CCGGCTTCATCATCTTCGATAA |
| mAsPCR-seg58.2...Recoded | GCATTGACAAGTTTTTTAACCTGTGATAG |

TABLE 4-continued

MASC primers (SEQ ID NOS 175-2262, respectively, in order of appearance) used for analysis of recoded segments.

| Primer | Sequence |
| --- | --- |
| mAsPCR-seg58.2..Reverse | TTATCATGTGGCGTAAAGAAACAGG |
| mAsPCR-seg58.2..Wild-Type | GCATTGACAAGTTTTTAACCTGACTCAA |
| mAsPCR-seg58.3..Recoded | CAACCGCTACTTCTATCTCTTCTT |
| mAsPCR-seg58.3..Reverse | CGAAGATCGTATACTTCAAGCAATGATT |
| mAsPCR-seg58.3..Wild-Type | CAACCGCTATTGCTAAGTTTGTTG |
| mAsPCR-seg58.4..Recoded | GGTATGCCTGTTCCCGTGA |
| mAsPCR-seg58.4..Reverse | TCATCGTCTATTCAACGGGCAA |
| mAsPCR-seg58.4..Wild-Type | GGTATGCCTGTTCCCGGCT |
| mAsPCR-seg58.5..Recoded | AGATTGACCCTAATAATAACCCCTCA |
| mAsPCR-seg58.5..Reverse | CTGGTACTGGATTGTATTGATCGCT |
| mAsPCR-seg58.5..Wild-Type | AGATTGACCCTAATAATAACCCCAGC |
| mAsPCR-seg58.6..Recoded | CTCTTAAATTCAAACTGGCCCTTCTT |
| mAsPCR-seg58.6..Reverse | AGTAAGTGCCGCCAGTGAG |
| mAsPCR-seg58.6..Wild-Type | GCCTTAAATTCAAACTGGCCTTGTTG |
| mAsPCR-seg58.7..Recoded | CCGCACCTGATCCCATCA |
| mAsPCR-seg58.7..Reverse | CGTCGAGCATCTCCTGTGG |
| mAsPCR-seg58.7..Wild-Type | CCGCACCTGATCCCAAGC |
| mAsPCR-seg58.8..Recoded | CAATCACAACCAAACGACTCATCA |
| mAsPCR-seg58.8..Reverse | GAACCAGTCGCCCCAGGA |
| mAsPCR-seg58.8..Wild-Type | CAATCACAACCAAACGACAGCAGT |
| mAsPCR-seg59.1..Recoded | AGCCAGTTCCGGGTCGATT |
| mAsPCR-seg59.1..Reverse | GTTAACGGCTGAAGGACATCG |
| mAsPCR-seg59.1..Wild-Type | AGCCAGTTCCGGGTCGATG |
| mAsPCR-seg59.2..Recoded | GGTACGAATCGACATATAGCCTGA |
| mAsPCR-seg59.2..Reverse | CATTTGTTGTTATTTTGCACGGTTTTG |
| mAsPCR-seg59.2..Wild-Type | GGTACGAATCGACATATAGCCACT |
| mAsPCR-seg59.3..Recoded | ACAACTATAACTTCTGTCTTGATGGTCTT |
| mAsPCR-seg59.3..Reverse | GGTTTGCCGGACATTTTTGAGA |
| mAsPCR-seg59.3..Wild-Type | ACAACTATAACTTCTGTCTTGATGGTTTG |
| mAsPCR-seg59.4..Recoded | AACGAACGTAATACCAAACCCTCT |
| mAsPCR-seg59.4..Reverse | CGTCCAGTCTGAACGTTTGC |
| mAsPCR-seg59.4..Wild-Type | AACGAACGTAATACCAAACCCAGC |
| mAsPCR-seg59.5..Recoded | TGAGATGTATGAGTCGCCAATAGA |
| mAsPCR-seg59.5..Reverse | CCTGAAGATAAGTAAGATTTGACATAACCG |
| mAsPCR-seg59.5..Wild-Type | ACTGATGTATGAGTCGCCAATGCT |
| mAsPCR-seg59.6..Recoded | TATTCAGGCCATTCATAAGCAGAAATGA |
| mAsPCR-seg59.6..Reverse | TTCGTACACTAATTACCCTTCGCA |

TABLE 4-continued

MASC primers (SEQ ID NOS 175-2262, respectively, in order of appearance) used for analysis of recoded segments.

| Primer | Sequence |
| --- | --- |
| mAsPCR-seg59.6..Wild-Type | TATTCAGGCCATTCATAAGCAGAAAACT |
| mAsPCR-seg59.7..Recoded | AAGAAGAGCTTTCAAAGATTCGTTCA |
| mAsPCR-seg59.7..Reverse | CGTGATGAGTGTCCGCCATA |
| mAsPCR-seg59.7..Wild-Type | AAGAAGAGTTGAGTAAGATTCGTAGC |
| mAsPCR-seg59.8..Recoded | GCAAAAATGGACTGGTACCTGAAG |
| mAsPCR-seg59.8..Reverse | TAGATTGTCGTCAGGATGCCTTC |
| mAsPCR-seg59.8..Wild-Type | GCAAAAATGGACTGGTATCTGAAA |
| mAsPCR-seg60.1..Recoded | GTTTTTACCTAGATAACCTGAAATGACTGA |
| mAsPCR-seg60.1..Reverse | GCACCGCGTGTTTCACTC |
| mAsPCR-seg60.1..Wild-Type | GTTTTTACCTAAATAACCGCTAATGACGCT |
| mAsPCR-seg60.2..Recoded | GCGCCGATTCAATACCCGAAAG |
| mAsPCR-seg60.2..Reverse | CCTACGCCAACCCGAACA |
| mAsPCR-seg60.2..Wild-Type | GCGCCGATTCAATACCACTTAA |
| mAsPCR-seg60.3..Recoded | CCTCTAAAAATAACGCCTGTTCTCATATCA |
| mAsPCR-seg60.3..Reverse | CCTCCCGGGTAAAATATTGCTT |
| mAsPCR-seg60.3..Wild-Type | TTACTAAAAATAACGCCTGTTTTAATAAGC |
| mAsPCR-seg60.4..Recoded | TAACCCATCGAAACCGCAGAAAG |
| mAsPCR-seg60.4..Reverse | ATCATTTCAGGGATTGCAGTGC |
| mAsPCR-seg60.4..Wild-Type | TAACCCATCGAAACCGCACTTAA |
| mAsPCR-seg60.5..Recoded | CACGCTATGCCAAATATTGTTCTATCA |
| mAsPCR-seg60.5..Reverse | CGTTAATGCGATTCACCGGAAC |
| mAsPCR-seg60.5..Wild-Type | CACGCTATGCCAAATATTGTTTTAAGC |
| mAsPCR-seg60.6..Recoded | GATGCGATTTTCTGGTTTACTCTTCTC |
| mAsPCR-seg60.6..Reverse | CGATGTCACCACGTTAATATGCAC |
| mAsPCR-seg60.6..Wild-Type | GATGCGATTTTCTGGTTTACTTTGTTG |
| mAsPCR-seg60.7..Recoded | GTTTACCTCTGCAACGCTATCTTC |
| mAsPCR-seg60.7..Reverse | TGTGTGAATCGGGTGTTAACAGA |
| mAsPCR-seg60.7..Wild-Type | GTTTACCTCTGCAACCCTAAGTAG |
| mAsPCR-seg60.8..Recoded | ACCACTTTCGCAGATCCTCTCT |
| mAsPCR-seg60.8..Reverse | GGTGAAAGCGCGAAGTAACAAATA |
| mAsPCR-seg60.8..Wild-Type | ACCACTTAGCCAGATCTTAAGC |
| mAsPCR-seg61.1..Recoded | CCAGCAGCAGATCCAGTGA |
| mAsPCR-seg61.1..Reverse | CTGATCTTTACCTGGTTCTGTATGCT |
| mAsPCR-seg61.1..Wild-Type | CCAGCAGGAGATCCAGACT |
| mAsPCR-seg61.2..Recoded | CGTTCCATAAGCGTTTGTTCCGA |
| mAsPCR-seg61.2..Reverse | GCACTTACGCTTGCAGGATG |
| mAsPCR-seg61.2..Wild-Type | CTTTCCATTAACGTTTGTTCGCT |
| mAsPCR-seg61.3..Recoded | GCCGCACGTTATGAAGATGAAT |

TABLE 4-continued

MASC primers (SEQ ID NOS 175-2262, respectively, in order of appearance) used for analysis of recoded segments.

| Primer | Sequence |
|---|---|
| mAsPCR-seg61.3..Reverse | CGCAAGCACCTACCGGAT |
| mAsPCR-seg61.3..Wild-Type | GCCGCACGTTATGAAGATGAAA |
| mAsPCR-seg61.4..Recoded | GGCCTTTGTTTTCCAGATTCTCA |
| mAsPCR-seg61.4..Reverse | CGCCTGCTCACCGGTATT |
| mAsPCR-seg61.4..Wild-Type | GGCCTTTGTTTTCCAGATTCTCC |
| mAsPCR-seg61.5..Recoded | TGAGGGCGACGCAATCTC |
| mAsPCR-seg61.5..Reverse | CGCACGATTATAGTTACGCTCAAT |
| mAsPCR-seg61.5..Wild-Type | TGAGGGCGACGCAATCAG |
| mAsPCR-seg61.6..Recoded | TGGCTGACGTCGGTATGC |
| mAsPCR-seg61.6..Reverse | TCGATGAGGTGAAGCAGGAC |
| mAsPCR-seg61.6..Wild-Type | TGGCTGACGTCGGTATGT |
| mAsPCR-seg61.7..Recoded | TCATCATCACCGTAGAATGAAGAAG |
| mAsPCR-seg61.7..Reverse | GTCTGATTGGCGGGCAAAT |
| mAsPCR-seg61.7..Wild-Type | TCATCATCACCGTACTATGCAACAA |
| mAsPCR-seg61.8..Recoded | GAGGCCCGACTGATCATTTCA |
| mAsPCR-seg61.8..Reverse | TGGAATGACATACTCAGGTTCGC |
| mAsPCR-seg61.8..Wild-Type | GAGGCCAGACTGATCATTAGC |
| mAsPCR-seg62.1..Recoded | CATCATCTTCTCAAACACCGCAAG |
| mAsPCR-seg62.1..Reverse | AAAATTTTCGCCATGTATTACCAGGT |
| mAsPCR-seg62.1..Wild-Type | CATCATCTTCTCAAACACCGCTAA |
| mAsPCR-seg62.2..Recoded | GCTTCGCGTATTCCTGATAGTCT |
| mAsPCR-seg62.2..Reverse | CCGGAATATCGCTAAAGATCGC |
| mAsPCR-seg62.2..Wild-Type | GCTTCGCGTATTCCTGATAGTCG |
| mAsPCR-seg62.3..Recoded | CGATCTAAAAGTGGGCAAATTCTCA |
| mAsPCR-seg62.3..Reverse | GTGTGAAGAGTTCCACCATGAG |
| mAsPCR-seg62.3..Wild-Type | CGATCTAAAAGTGGGCAAATTCAGC |
| mAsPCR-seg62.4..Recoded | CAGGGTCAGTTTTACCCCTGA |
| mAsPCR-seg62.4..Reverse | CACTCCTGACTCCTTTTGACCA |
| mAsPCR-seg62.4..Wild-Type | CAGGGTCAGTTTTACCCCACT |
| mAsPCR-seg62.5..Recoded | TTTTACGAGCGCCATGTCAAAC |
| mAsPCR-seg62.5..Reverse | CGACAAAGTCCGGCAAACC |
| mAsPCR-seg62.5..Wild-Type | TTTTACGAGCGCCATGTCAAAT |
| mAsPCR-seg62.6..Recoded | CACAGCAGTAGGGATATGCGA |
| mAsPCR-seg62.6..Reverse | CGCTAAACTTGCGTGACTACA |
| mAsPCR-seg62.6..Wild-Type | CACAGCAGTAGGGATATGGCT |
| mAsPCR-seg62.7..Recoded | GAATTCCGGTAACCAGATTGACA |
| mAsPCR-seg62.7..Reverse | GAAGCCGGTCGAATTTACTACC |

TABLE 4-continued

MASC primers (SEQ ID NOS 175-2262, respectively, in order of appearance) used for analysis of recoded segments.

| Primer | Sequence |
| --- | --- |
| mAsPCR-seg62.7..Wild-Type | GAATTCCGGTAACCAGATTGACG |
| mAsPCR-seg62.8..Recoded | GGCCTGGTATCACTCTCCT |
| mAsPCR-seg62.8..Reverse | GCCGTTTCCAGCGCAATATT |
| mAsPCR-seg62.8..Wild-Type | GGCCTGGTAAGCCTCTCCA |
| mAsPCR-seg63.1..Recoded | CACGTCTTCAACCTGTTATTCGTC |
| mAsPCR-seg63.1..Reverse | GTATTCGCAGTACCCAGGTCAA |
| mAsPCR-seg63.1..Wild-Type | GTCGTTTACAACCTGTTATTCGTT |
| mAsPCR-seg63.2..Recoded | ATGAATATCTGAAATCTCTAGGTGCTTCA |
| mAsPCR-seg63.2..Reverse | GCTGTTTAGTGGAGTATCAATGCG |
| mAsPCR-seg63.2..Wild-Type | ATGAATATCTGAAAAGTTTAGGTGCTAGC |
| mAsPCR-seg63.3..Recoded | CATAAGCCAGTTTTGAACAATTCCAGA |
| mAsPCR-seg63.3..Reverse | TCTGAAGACCCGGCAAGAAC |
| mAsPCR-seg63.3..Wild-Type | CATTAACCAGTTTTGAACAATTCCGCT |
| mAsPCR-seg63.4..Recoded | CGCTTCCAGGGCAACAACTT |
| mAsPCR-seg63.4..Reverse | CGTTGCTCGCATATTCTGTAGG |
| mAsPCR-seg63.4..Wild-Type | CGTTACCAGGGCAACAATTG |
| mAsPCR-seg63.5..Recoded | TGCCGATTGTGCGTATCCTT |
| mAsPCR-seg63.5..Reverse | GTATTTACCAGCCCAGGAATTACC |
| mAsPCR-seg63.5..Wild-Type | TGCCGATTGTGCGTATCTTA |
| mAsPCR-seg63.6..Recoded | GCACCTTTACCACCAGCTGA |
| mAsPCR-seg63.6..Reverse | GTTGTGCCTTGTGAAACGG |
| mAsPCR-seg63.6..Wild-Type | GCACCTTTACCACCAGCACT |
| mAsPCR-seg63.7..Recoded | CCAATACCTTCTTCTGCGTACATT |
| mAsPCR-seg63.7..Reverse | TGTCAATCAGAGGGGGATTTGT |
| mAsPCR-seg63.7..Wild-Type | CCAATACCTTCTTCTGCGTACATC |
| mAsPCR-seg63.8..Recoded | ACGTGAGAATCATCATCCAGTATTAG |
| mAsPCR-seg63.8..Reverse | ACCCGTAGTATCCCCACTTATCT |
| mAsPCR-seg63.8..Wild-Type | ACGTGAGAATCATCATCCAGTATCAA |
| mAsPCR-seg64.1..Recoded | GCAGACGACCGATTGCAGA |
| mAsPCR-seg64.1..Reverse | AGCTGTGGGTAAAGCTGTCG |
| mAsPCR-seg64.1..Wild-Type | GCAGACGACCGATTGCACT |
| mAsPCR-seg64.2..Recoded | GCTCCGCTTCTGGAAAAAAACT |
| mAsPCR-seg64.2..Reverse | CGACCTTCACCACCACCAT |
| mAsPCR-seg64.2..Wild-Type | GCTCCGTTGCTGGAAAAAACA |
| mAsPCR-seg64.3..Recoded | TAAGTGCGGAAGTTGCCAGAAG |
| mAsPCR-seg64.3..Reverse | CTATCTCTACATCCGCCAGTTCAA |
| mAsPCR-seg64.3..Wild-Type | TTAATGCGGAAGTTGCCAGTAA |
| mAsPCR-seg64.4..Recoded | ACACCGGAGACTCATCAACTAG |

TABLE 4-continued

MASC primers (SEQ ID NOS 175-2262, respectively, in order of appearance) used for analysis of recoded segments.

| Primer | Sequence |
| --- | --- |
| mAsPCR-seg64.4..Reverse | CGGCTGGGATGAATTTGAGTG |
| mAsPCR-seg64.4..Wild-Type | TCACCGGAGACTCATCAACCAA |
| mAsPCR-seg64.5..Recoded | GCCGCCATTTTACCCTCTCA |
| mAsPCR-seg64.5..Reverse | ATCCGCTTGTAGTCAGTATTATTTTGC |
| mAsPCR-seg64.5..Wild-Type | GCCGCCATTTTTACCCTCAGT |
| mAsPCR-seg64.6..Recoded | CTGCTATTTACCGACTCCTTCTTCTC |
| mAsPCR-seg64.6..Reverse | GGAGATAAAACCAAGCTGACCGA |
| mAsPCR-seg64.6..Wild-Type | CTGTTATTTACCGACTCCTTCTTCAG |
| mAsPCR-seg64.7..Recoded | CATCGCGATTATGCCCAGTC |
| mAsPCR-seg64.7..Reverse | CGTGACTGCCGTACCGTT |
| mAsPCR-seg64.7..Wild-Type | CATCGCGATTATGCCCAGAG |
| mAsPCR-seg64.8..Recoded | ATCAAAAACGATCTCAAGCAGCTT |
| mAsPCR-seg64.8..Reverse | TCCAGGTAAATTCCATCAGCGTTA |
| mAsPCR-seg64.8..Wild-Type | ATCAAAAACGATCTCAAGCAGTTG |
| mAsPCR-seg65.1..Recoded | GCAGGGTGTAGTCGATTGATGA |
| mAsPCR-seg65.1..Reverse | GTCTACCTGTGGCGCATCA |
| mAsPCR-seg65.1..Wild-Type | GCAGGGTGTAGTCGATACTGCT |
| mAsPCR-seg65.2..Recoded | CGCATTACACTCTGCAGCTGT |
| mAsPCR-seg65.2..Reverse | ACCTCGGCGCAATTTGTTTC |
| mAsPCR-seg65.2..Wild-Type | GCCATTACACTCTGCAGCTGA |
| mAsPCR-seg65.3..Recoded | TCATCTGAAACCTTCCGTGTGAG |
| mAsPCR-seg65.3..Reverse | TACTGATGAACCCGCCAATTAATTTT |
| mAsPCR-seg65.3..Wild-Type | TCATCGCTAACCTTCCTTGTTAA |
| mAsPCR-seg65.4..Recoded | TTTCTCGCTGGGATGCATCA |
| mAsPCR-seg65.4..Reverse | ACATCGTTATTTTCCAGCACGTTC |
| mAsPCR-seg65.4..Wild-Type | TTTCTCGCTGGGATGCAAGT |
| mAsPCR-seg65.5..Recoded | GTACATGATATCGTTTACAACCCATCA |
| mAsPCR-seg65.5..Reverse | CCACAGAAAGCGTCGACAAC |
| mAsPCR-seg65.5..Wild-Type | GTACATGATATCGTTTACAACCCAAGC |
| mAsPCR-seg65.6..Recoded | GCTTCTTCTCATCGTCACCCTT |
| mAsPCR-seg65.6..Reverse | GAATTCATAGTGTTGCGCCCAA |
| mAsPCR-seg65.6..Wild-Type | GTTATTGCTCATCGTCACCTTG |
| mAsPCR-seg65.7..Recoded | CGTGTCCATGCCGTTTCTC |
| mAsPCR-seg65.7..Reverse | AAAGTTCTGTCTCGCCATTTCAAAA |
| mAsPCR-seg65.7..Wild-Type | CGTGTCCATGCCGTTTTTG |
| mAsPCR-seg65.8..Recoded | CGGAATTGGCTTATCGATACCTTTT |
| mAsPCR-seg65.8..Reverse | GTGACCCACGGCTTCCTG |

TABLE 4-continued

MASC primers (SEQ ID NOS 175-2262, respectively, in order of appearance) used for analysis of recoded segments.

| Primer | Sequence |
| --- | --- |
| mAsPCR-seg65.8..Wild-Type | CGGAATTGGCTTATCGATACCTTTC |
| mAsPCR-seg66.1..Recoded | GTTCACTCCGGCTTATGTCA |
| mAsPCR-seg66.1..Reverse | GGTCGCCCATCCCTCATG |
| mAsPCR-seg66.1..Wild-Type | GGAGTCTGCGGTTGATGAGC |
| mAsPCR-seg66.2..Recoded | CAGCGAGGTAAGAATCCATTTACG |
| mAsPCR-seg66.2..Reverse | GGTGCGCTGACTATCGGT |
| mAsPCR-seg66.2..Wild-Type | CAGCGAGGTCAAAATCCATTTTCT |
| mAsPCR-seg66.3..Recoded | CGGTAAATGCGGTAAGACCTGAT |
| mAsPCR-seg66.3..Reverse | TGGTGGTTATCAGGTGGGAAATT |
| mAsPCR-seg66.3..Wild-Type | CGGTAAATGCGGTTAAACCACTG |
| mAsPCR-seg66.4..Recoded | CCCTCAGCTTCAGGAAATTCA |
| mAsPCR-seg66.4..Reverse | CGTTGGGATGATTGCGTTCC |
| mAsPCR-seg66.4..Wild-Type | CCCAGCGCTTCAGGAAATAGC |
| mAsPCR-seg66.5..Recoded | CCTGGCTGGTTACCGGTT |
| mAsPCR-seg66.5..Reverse | ACCTTAGTACCCCGCCGTA |
| mAsPCR-seg66.5..Wild-Type | CCTGGCTGGTTACCGGTA |
| mAsPCR-seg66.6..Recoded | CTCACCTTTAAACATTTTAGAGTACCATGA |
| mAsPCR-seg66.6..Reverse | GAGTATGATGTCGAACTGGCCTTA |
| mAsPCR-seg66.6..Wild-Type | CTCACCTTTAAACATTTTGCTGTACCAACT |
| mAsPCR-seg66.7..Recoded | GTCACCATAGGCCAGGTTTGA |
| mAsPCR-seg66.7..Reverse | ATGTGCGTCTGTTCCGTGAA |
| mAsPCR-seg66.7..Wild-Type | GTCACCATAGGCCAGGTTACT |
| mAsPCR-seg66.8..Recoded | CTGATTATCGCCGGTGCCT |
| mAsPCR-seg66.8..Reverse | CAGTACCGCGGGCTTGTT |
| mAsPCR-seg66.8..Wild-Type | CTGATTATCGCCGGTGCCA |
| mAsPCR-seg67.1..Recoded | TTTTTTTAGTCGCCACGTCAGAAG |
| mAsPCR-seg67.1..Reverse | GGAACGGCATTGTCACTTACG |
| mAsPCR-seg67.1..Wild-Type | TTTTTTTAATCGCCACGTCAGTAA |
| mAsPCR-seg67.2..Recoded | TCACATTGTCAGCTTGAAAATCTCTCT |
| mAsPCR-seg67.2..Reverse | TCTGTTTTGGAGAGTGCTTTAACATC |
| mAsPCR-seg67.2..Wild-Type | AGCCATTGTCAGCTTGAAAATTTAAGC |
| mAsPCR-seg67.3..Recoded | CAATATTTTAATCTGGGTATCAAAGAGCTA |
| mAsPCR-seg67.3..Reverse | CATCACCCCGCCAAACCA |
| mAsPCR-seg67.3..Wild-Type | CAATATTTTAATCTGGGTATCAAAGAGTTG |
| mAsPCR-seg67.4..Recoded | GCGTGCTCATATTCTACGTCGTAATAAC |
| mAsPCR-seg67.4..Reverse | TCATCTTCTATATTAAGTAGCTGTGAAAGGA |
| mAsPCR-seg67.4..Wild-Type | GCGTGCTCATATTCTACGTAGGAATAAT |
| mAsPCR-seg67.5..Recoded | CTTCATACCGGGCTGCTACTTCTT |

TABLE 4-continued

MASC primers (SEQ ID NOS 175-2262, respectively, in order of appearance) used for analysis of recoded segments.

| Primer | Sequence |
| --- | --- |
| mAsPCR-seg67.5..Reverse | GATGCAGGTAGACCAAAGTACC |
| mAsPCR-seg67.5..Wild-Type | TTGCATACCGGGCTGTTATTATTG |
| mAsPCR-seg67.6..Recoded | CTATCAATAAATTCAACTGGGAAACGCTA |
| mAsPCR-seg67.6..Reverse | GCAGGAAGGGCGAAGAAG |
| mAsPCR-seg67.6..Wild-Type | CTATCAATAAATTCAACTGGGAAACGTTG |
| mAsPCR-seg67.7..Recoded | TAACTTCCTCACTCAAATAGAACGACTTAAG |
| mAsPCR-seg67.7..Reverse | TTGATTCGCAATGCATGACAGA |
| mAsPCR-seg67.7..Wild-Type | TAATTTTCTCACTCAAATTGAACGATTAAAA |
| mAsPCR-seg67.8..Recoded | CGCCGCTACCATCAGGATATTAG |
| mAsPCR-seg67.8..Reverse | GCCTCTATCACTCTGACCTTCG |
| mAsPCR-seg67.8..Wild-Type | CGCCGCTACCATCAGGATATTAC |
| mAsPCR-seg68.1..Recoded | CGCCCGCTCTTCATCTGA |
| mAsPCR-seg68.1..Reverse | ACCTGTCAAAAAATATAACGCACTAATATCA |
| mAsPCR-seg68.1..Wild-Type | CGCCCGCTCTTCATCACT |
| mAsPCR-seg68.2..Recoded | GTGAGGCCCCCTGAATTGA |
| mAsPCR-seg68.2..Reverse | CATTTCTTTGACCGATTGTTGTTCAC |
| mAsPCR-seg68.2..Wild-Type | GACTGGCCCCCTGAATACT |
| mAsPCR-seg68.3..Recoded | TCGCCACGACAATTAGGAGTAG |
| mAsPCR-seg68.3..Reverse | GTCTTCCCTGGCTGCGTT |
| mAsPCR-seg68.3..Wild-Type | TCGCCACGACAATCAACAACAA |
| mAsPCR-seg68.4..Recoded | ACCGCCGAACAGCTTTACTC |
| mAsPCR-seg68.4..Reverse | CCATATTCGGGTGCATCAGTTG |
| mAsPCR-seg68.4..Wild-Type | ACCGCCGAACAGCTTTACAG |
| mAsPCR-seg68.5..Recoded | GATAACGAGTAATTGAAGATGAATGTGCTA |
| mAsPCR-seg68.5..Reverse | TTTCTTGCCCCACAGCCA |
| mAsPCR-seg68.5..Wild-Type | GATAACGAGTAATTGAAGATGAATGTGTTG |
| mAsPCR-seg68.6..Recoded | TGATTGGGGCCATTTTTGTTCTTC |
| mAsPCR-seg68.6..Reverse | TATTCAGCCAGGTTAAGGTT |
| mAsPCR-seg68.6..Wild-Type | TGATTGGGGCCATTTTTGTTTTAT |
| mAsPCR-seg68.7..Recoded | GCTCCGGTTTACTCAATCAGCTTA |
| mAsPCR-seg68.7..Reverse | CGATTTGGGTTTCGTTTCGTGT |
| mAsPCR-seg68.7..Wild-Type | GCTCCGGTTTACTCAATCAGCTTC |
| mAsPCR-seg68.8..Recoded | CCAGAGTTTTAGCCTGAACCGA |
| mAsPCR-seg68.8..Reverse | GGGCAAAAAACAAAAAAGGTCAGG |
| mAsPCR-seg68.8..Wild-Type | CCAGAGTTTTAGCCTGAACACT |
| mAsPCR-seg69.1..Recoded | CGGACGTAGATGTGGGAATTTCT |
| mAsPCR-seg69.1..Reverse | GTGTAACGCTCTGTGGAAAGTC |

TABLE 4-continued

MASC primers (SEQ ID NOS 175-2262, respectively, in order of appearance) used for analysis of recoded segments.

| Primer | Sequence |
| --- | --- |
| mAsPCR-seg69.1..Wild-Type | CGGACGTAGATGTGGGAATTTCG |
| mAsPCR-seg69.2..Recoded | CAAAGACCGGTTTAAGATCATCTGA |
| mAsPCR-seg69.2..Reverse | ACGGCACTATCATTTTTAACAATGAAAC |
| mAsPCR-seg69.2..Wild-Type | CAAAGACCGGTTTCAAATCATCGCT |
| mAsPCR-seg69.3..Recoded | TAAAAAATCAGACAAAGGCCGATACGT |
| mAsPCR-seg69.3..Reverse | AACCTTTACCCGTTGTGCTTTC |
| mAsPCR-seg69.3..Wild-Type | TAAAAAATCAGACATAAGCCGATACGC |
| mAsPCR-seg69.4..Recoded | CCGAAAGTGCCTGAATTGCA |
| mAsPCR-seg69.4..Reverse | CGTATAACGGTCAGGTACTTTCCA |
| mAsPCR-seg69.4..Wild-Type | CGCTTAATGCCTGAATTGCC |
| mAsPCR-seg69.5..Recoded | CTTGTTTGGAGGATACCTGTTTATTCGA |
| mAsPCR-seg69.5..Reverse | TTTAGCGCCAATCTGAATCGTTAAC |
| mAsPCR-seg69.5..Wild-Type | CTTGTTTACTGCTTACCTGTTTATTACT |
| mAsPCR-seg69.6..Recoded | TAAGGACCCGATTAAAGGCTGCTTTA |
| mAsPCR-seg69.6..Reverse | TTTTTTTCCCATCACTTCTTTCCC |
| mAsPCR-seg69.6..Wild-Type | TTAAGACCCGATTAAAGGCTGCTTTT |
| mAsPCR-seg69.7..Recoded | CCGGACTCGAGATGACCTC |
| mAsPCR-seg69.7..Reverse | GACACATCCGCCAGCATT |
| mAsPCR-seg69.7..Wild-Type | CCGGACTCGAGATGACCAG |
| mAsPCR-seg69.8..Recoded | GGGTTTACTTTCGCCTGAGA |
| mAsPCR-seg69.8..Reverse | GGTGGATCGGCTGATGGC |
| mAsPCR-seg69.8..Wild-Type | GGGTTTACTTTCGCCTGGCT |
| mAsPCR-seg70.1..Recoded | CGGACGACTATGGCTGGATC |
| mAsPCR-seg70.1..Reverse | CGCATCGGTTTATTTACACCAGTC |
| mAsPCR-seg70.1..Wild-Type | CGGACGATTGTGGCTGGATT |
| mAsPCR-seg70.2..Recoded | TGCGCCCGAATAACCGTCTA |
| mAsPCR-seg70.2..Reverse | GTCTGGAGTATTATCGTCGGCTTTA |
| mAsPCR-seg70.2..Wild-Type | TGCGCCCGAATAACAGATTG |
| mAsPCR-seg70.3..Recoded | AGGCGATATCCGGGTCTTCT |
| mAsPCR-seg70.3..Reverse | TTACTGTCAAACACTCTCTGATCTTCAA |
| mAsPCR-seg70.3..Wild-Type | AGGCGATATCCGGGTCTTCA |
| mAsPCR-seg70.4..Recoded | GGAACGACACGCCCTTAGAT |
| mAsPCR-seg70.4..Reverse | AACAATGTTGGTGAGCTTGAGA |
| mAsPCR-seg70.4..Wild-Type | GGAAACTCACGCCCTTGCTG |
| mAsPCR-seg70.5..Recoded | CCTTGTTCGTGTTAATCCCAAGA |
| mAsPCR-seg70.5..Reverse | GCCAGCGTTTCGTACCATG |
| mAsPCR-seg70.5..Wild-Type | CCTTGTTCGTGTTAATCCCAGCT |
| mAsPCR-seg70.6..Recoded | AAGAACTCAACGCGCTACTTC |

TABLE 4-continued

MASC primers (SEQ ID NOS 175-2262, respectively, in order of appearance) used for analysis of recoded segments.

| Primer | Sequence |
| --- | --- |
| mAsPCR-seg70.6..Reverse | GCTTTTATGGGGCCGCGAGA |
| mAsPCR-seg70.6..Wild-Type | AAGAACTCAACGCGCTATTGT |
| mAsPCR-seg70.7..Recoded | ACTGGAGCTTATCAGTGTTAATTCCATAC |
| mAsPCR-seg70.7..Reverse | TTCTGAATGTTTAAATGTTGCCTATGGT |
| mAsPCR-seg70.7..Wild-Type | ACTGGAGCTTATCAGTGTTAATTCTATAT |
| mAsPCR-seg70.8..Recoded | CCAATAAAAAGCACTGCATGATCAATAAG |
| mAsPCR-seg70.8..Reverse | CGAGGCTATCAGGTTGTGCT |
| mAsPCR-seg70.8..Wild-Type | CCAATAAAAAGCACTGCATGATCAATTAA |
| mAsPCR-seg71.1..Recoded | GCTGGGTAAATGGGCTGATCTT |
| mAsPCR-seg71.1..Reverse | GATGGTCTTTTAGTGCGGCAAC |
| mAsPCR-seg71.1..Wild-Type | GCTGGGTAAATGGGCTGATTTA |
| mAsPCR-seg71.2..Recoded | AAATGAGCTAAAAGAACATAACAAACAACTT |
| mAsPCR-seg71.2..Reverse | GGGGAGGGGAAATTGATAACTTGTA |
| mAsPCR-seg71.2..Wild-Type | AAATGAGTTGAAAGAACATAACAAACAATTG |
| mAsPCR-seg71.3..Recoded | GCGACCATCTTTCTCTTCCGTATTA |
| mAsPCR-seg71.3..Reverse | TGCTCAACCATGCTCTAGGTG |
| mAsPCR-seg71.3..Wild-Type | GCGACCATCTTTCTCTTCCGTATTC |
| mAsPCR-seg71.4..Recoded | GCGTGGTTTATGGGCATGCTA |
| mAsPCR-seg71.4..Reverse | CCGGTTCTGGAATGTGTTGTAC |
| mAsPCR-seg71.4..Wild-Type | GCGTGGTTTATGGGCATGTTG |
| mAsPCR-seg71.5..Recoded | GACGGAATTATGGTTGAAATCTGGTC |
| mAsPCR-seg71.5..Reverse | CGACGACATCTGGGATTGCT |
| mAsPCR-seg71.5..Wild-Type | GACGGAATTATGGTTGAAATCTGGAG |
| mAsPCR-seg71.6..Recoded | GTCCAAAAGCCTCAATTCTTTCA |
| mAsPCR-seg71.6..Reverse | GCAATCTTATCAATCACCCGAAGTC |
| mAsPCR-seg71.6..Wild-Type | GTCCAAAAGCCAGCATTTTGAGC |
| mAsPCR-seg71.7..Recoded | GATGATTGCCTTCTACGCCCTT |
| mAsPCR-seg71.7..Reverse | CGACGGGAAGATAAACATGCC |
| mAsPCR-seg71.7..Wild-Type | GATGATTGCCTTCTACGCCTTA |
| mAsPCR-seg71.8..Recoded | CGGAATCGGCAGAATAAAAAGAATT |
| mAsPCR-seg71.8..Reverse | GCCTGCTTACCTCATATAAAACGC |
| mAsPCR-seg71.8..Wild-Type | CGGAATCGGCAGAATAAACAAAATA |
| mAsPCR-seg72.1..Recoded | TACATCGCCGCCCCTTTTG |
| mAsPCR-seg72.1..Reverse | CGGTATCTACGCTAACCAGTCC |
| mAsPCR-seg72.1..Wild-Type | TACATCGCCGCCCCTTTAC |
| mAsPCR-seg72.2..Recoded | TGAAATCTGCGGAGTTAAGTCGAATA |
| mAsPCR-seg72.2..Reverse | TCACCGCCAGACAAGCAC |

TABLE 4-continued

MASC primers (SEQ ID NOS 175-2262, respectively, in order of appearance) used for analysis of recoded segments.

| Primer | Sequence |
| --- | --- |
| mAsPCR-seg72.2..Wild-Type | TGAAATCTGCGGAGTTAAGTCGAATT |
| mAsPCR-seg72.3..Recoded | AATCCCCTCCAGCGACGA |
| mAsPCR-seg72.3..Reverse | TGAGGTTTATCACGACTCTCTGTG |
| mAsPCR-seg72.3..Wild-Type | AATCCCCTCCAGCGAGCT |
| mAsPCR-seg72.4..Recoded | CTACTCGTTTAAAGGATTAATCATGAAGCTA |
| mAsPCR-seg72.4..Reverse | GCCAGTGCCTTTTCTTCTTCG |
| mAsPCR-seg72.4..Wild-Type | CTACTCGTTTAAAGGATTAATCATGAAGTTG |
| mAsPCR-seg72.5..Recoded | ATTTCCATCTCCGCACCAGA |
| mAsPCR-seg72.5..Reverse | TGCGCGTACAGATTGGCT |
| mAsPCR-seg72.5..Wild-Type | ATTTCCATCTCCGCACCGCT |
| mAsPCR-seg72.6..Recoded | AAGCACGTCAGGGTTCACTT |
| mAsPCR-seg72.6..Reverse | GCCTGTTCAATTTCCTGCCA |
| mAsPCR-seg72.6..Wild-Type | AAGCACGTCAGGGTAGTTTG |
| mAsPCR-seg72.7..Recoded | GGTTTTTCCGGTCGCGAATC |
| mAsPCR-seg72.7..Reverse | GTCCAGCGCCCAGGTATC |
| mAsPCR-seg72.7..Wild-Type | GGTTTTTCCGGTCGCGAAAG |
| mAsPCR-seg72.8..Recoded | ATTACCGAAGATTACCAGGAAATGT |
| mAsPCR-seg72.8..Reverse | GCAGTTATCGTACCAGGGCTTA |
| mAsPCR-seg72.8..Wild-Type | ATTACCGAAGATTACCAGGAAATGA |
| mAsPCR-seg73.1..Recoded | ACAATCAGGTACTTATCTTATTCTATTCTCA |
| mAsPCR-seg73.1..Reverse | GCAGGTTGACGCCATATACC |
| mAsPCR-seg73.1..Wild-Type | ACAAAGTGGTACTTATTTAATTTTATTCAGC |
| mAsPCR-seg73.2..Recoded | ATCAGAGAGACAATAATGCCACCTAG |
| mAsPCR-seg73.2..Reverse | CCGGGTGCAATTGGTTATGTT |
| mAsPCR-seg73.2..Wild-Type | ATCAGAGAGACAATAATGCCACCCAA |
| mAsPCR-seg73.3..Recoded | ATACGTACCTGCGGATGACC |
| mAsPCR-seg73.3..Reverse | CATTGCCATATCACCCTCCGA |
| mAsPCR-seg73.3..Wild-Type | ATACGTACCTGCGGATGACT |
| mAsPCR-seg73.4..Recoded | CAGCTACTGGTGGTGATAGCAT |
| mAsPCR-seg73.4..Reverse | CGAGAATGTACGCAGGTCCA |
| mAsPCR-seg73.4..Wild-Type | CAGTTACTGGTGGTGATAGCAA |
| mAsPCR-seg73.5..Recoded | CATATAGCGCTTCCAGGGATGA |
| mAsPCR-seg73.5..Reverse | GCCCGCGCGTTTGAATAT |
| mAsPCR-seg73.5..Wild-Type | CATATAACGCTTCCAGACTGCT |
| mAsPCR-seg73.6..Recoded | TCAAACAACAAACCGCAGAATCC |
| mAsPCR-seg73.6..Reverse | GCGAGTATAGATGCCAGTAAGC |
| mAsPCR-seg73.6..Wild-Type | TCAAACAACAAACCGCAGAAAGT |
| mAsPCR-seg73.7..Recoded | ATCTGACCGATGACAATGCCT |

TABLE 4-continued

MASC primers (SEQ ID NOS 175-2262, respectively, in order of appearance) used for analysis of recoded segments.

| Primer | Sequence |
| --- | --- |
| mAsPCR-seg73.7..Reverse | CCATCGGTTGTTTTCAGAAGCAT |
| mAsPCR-seg73.7..Wild-Type | ATCTGACCGATGACAATGCCA |
| mAsPCR-seg73.8..Recoded | CACGTTAATTTTTAGAAGATCGCGAATAAG |
| mAsPCR-seg73.8..Reverse | AGATTGCGATGCTTAATGGTTGC |
| mAsPCR-seg73.8..Wild-Type | CACGTTAATTTTCAAAAGATCGCGAATCAA |
| mAsPCR-seg74.1..Recoded | CTTGGACGAGGAAAGGCTTGA |
| mAsPCR-seg74.1..Reverse | TTCGGCATGTGGGAAAGTCA |
| mAsPCR-seg74.1..Wild-Type | CTTGGAGGAGGAAAGGCTTAG |
| mAsPCR-seg74.2..Recoded | GACATCATCACCGTCGATTCT |
| mAsPCR-seg74.2..Reverse | GGTGCCATGTGAGCGATAGT |
| mAsPCR-seg74.2..Wild-Type | GACATCATCACCGTCGATAGC |
| mAsPCR-seg74.3..Recoded | CTAACCCGGACGATGACTCA |
| mAsPCR-seg74.3..Reverse | AAACTCCAGCCCTTTCGAC |
| mAsPCR-seg74.3..Wild-Type | CTAACCCGGACGATGACAGC |
| mAsPCR-seg74.4..Recoded | CAGGAGCCAAAGATATAACCCAGT |
| mAsPCR-seg74.4..Reverse | GTCTTCGTGGTTATACTTCTGCTAATAATTT |
| mAsPCR-seg74.4..Wild-Type | CAGGAGCCAAAGATATAACCCAGG |
| mAsPCR-seg74.5..Recoded | CTGAACTACTTTTCCTGATATGTCGCTT |
| mAsPCR-seg74.5..Reverse | ACAAAAACCAGCGCCATCAG |
| mAsPCR-seg74.5..Wild-Type | TTGAACTACTTTTCCTGATATGTCGTTG |
| mAsPCR-seg74.6..Recoded | CGTGGCTGTTTTTCCTTGTATC |
| mAsPCR-seg74.6..Reverse | GGTGTCGCGAGTGAGATAGAG |
| mAsPCR-seg74.6..Wild-Type | CGTGGCTGTTTTTCCTCGTCAG |
| mAsPCR-seg74.7..Recoded | ACCGTTCTGAATACATCAAGCAAC |
| mAsPCR-seg74.7..Reverse | TTTGGGTAGTTATCGAAGTGGCA |
| mAsPCR-seg74.7..Wild-Type | ACCGTTCTGAATACATCAAGCAAT |
| mAsPCR-seg74.8..Recoded | GCCAGAGTGCAAGTGGTG |
| mAsPCR-seg74.8..Reverse | ATCCACTGCCAGACCTCATTTT |
| mAsPCR-seg74.8..Wild-Type | GCCAGAGTGCAAGTGGGC |
| mAsPCR-seg75.1..Recoded | GTCGATTAGTTCCATAAATCGCTGAAG |
| mAsPCR-seg75.1..Reverse | GGATACCAACAACATTCAGTACGC |
| mAsPCR-seg75.1..Wild-Type | GTCGATTAATTCCATAAATCGCTGCAA |
| mAsPCR-seg75.2..Recoded | GCTTGCAGATGAAATTGAAAATATCTATTCT |
| mAsPCR-seg75.2..Reverse | AACAAATGGTTCTATGAGAAAGAGGTAAA |
| mAsPCR-seg75.2..Wild-Type | GTTGGCAGATGAAATTGAAAATATCTATAGC |
| mAsPCR-seg75.3..Recoded | TTCCAGACAGGTAAGGGTAGAGAAT |
| mAsPCR-seg75.3..Reverse | CGCTTCTTTCTCCCGACCA |

TABLE 4-continued

MASC primers (SEQ ID NOS 175-2262, respectively, in order of appearance) used for analysis of recoded segments.

| Primer | Sequence |
|---|---|
| mAsPCR-seg75.3..Wild-Type | TTCCAGACAGGTTAAGGTAGAGAAA |
| mAsPCR-seg75.4..Recoded | CACTTTTGCTACCAGACCTGA |
| mAsPCR-seg75.4..Reverse | CCGATTCAGGCAATGTGATTTGT |
| mAsPCR-seg75.4..Wild-Type | CACTTTTGCTACCAGACCGCT |
| mAsPCR-seg75.5..Recoded | GGGCAAGTATCTACAGCACTCA |
| mAsPCR-seg75.5..Reverse | GCAATAATTAGTAGCTGCCAAATGGA |
| mAsPCR-seg75.5..Wild-Type | GGGCAAGTATTTACAGCACAGT |
| mAsPCR-seg75.6..Recoded | GCCCAGGAACACCTCGAAC |
| mAsPCR-seg75.6..Reverse | GTTGCCGGATCGACAATGTC |
| mAsPCR-seg75.6..Wild-Type | GCCCAGGAACACCTCGAAA |
| mAsPCR-seg75.7..Recoded | TTTTCACGTGGTTCACTACAACTTC |
| mAsPCR-seg75.7..Reverse | ACAAAAAAGGTCTGGGTAAAAGCG |
| mAsPCR-seg75.7..Wild-Type | TTTAGCCGTGGTTCATTGCAATTGT |
| mAsPCR-seg75.8..Recoded | AGCTTTGAGGTATCCATTCGTGA |
| mAsPCR-seg75.8..Reverse | TATGGATGTTGATAAGCCAGGCAAA |
| mAsPCR-seg75.8..Wild-Type | AGCTTTGAGGTATCCATTCGACT |
| mAsPCR-seg76.1..Recoded | CCAGTTTACTTTTAATGGTGATGGTTCA |
| mAsPCR-seg76.1..Reverse | TTTCCGCATCCATTCCTTCAGA |
| mAsPCR-seg76.1..Wild-Type | CCAGTTTACTTTTAATGGTGATGGTAGT |
| mAsPCR-seg76.2..Recoded | CTTGTCCACGCCTTGTTTCTTTAG |
| mAsPCR-seg76.2..Reverse | AAATCCGCCTTTTATTATGGTTCAGG |
| mAsPCR-seg76.2..Wild-Type | CTTGTCCACGCCTTGTTTCTTCAA |
| mAsPCR-seg76.3..Recoded | CAGATCCTCAACTCGCTGATTAACT |
| mAsPCR-seg76.3..Reverse | AGACGGTCGACCAGATTTCG |
| mAsPCR-seg76.3..Wild-Type | CAGATCCTCAACTCGCTGATTAACA |
| mAsPCR-seg76.4..Recoded | CGAGCAGCATGAAGATCTTAAATCA |
| mAsPCR-seg76.4..Reverse | TGATTTTCTGGAAGTGGTGTTTCAG |
| mAsPCR-seg76.4..Wild-Type | CGAGCAGCATGAAGATTTAAAAAGT |
| mAsPCR-seg76.5..Recoded | GATCTTCCGTTGTGATGTGGGA |
| mAsPCR-seg76.5..Reverse | CGCACACTTACACCCTGAAATATC |
| mAsPCR-seg76.5..Wild-Type | GATCTTCCGTTGTGATGTGACT |
| mAsPCR-seg76.6..Recoded | CCTGGCCAAACAAAGTCCTCT |
| mAsPCR-seg76.6..Reverse | ATTCATTCATTTATTCCTTTATCCAGTCGTT |
| mAsPCR-seg76.6..Wild-Type | CCTGGCCAAACAAAGTCCTCA |
| mAsPCR-seg76.7..Recoded | CGAAATCTTTGGCGACGAAACT |
| mAsPCR-seg76.7..Reverse | GTATGGAGCCAACGAAGAATAAAAATTT |
| mAsPCR-seg76.7..Wild-Type | CGAAATCTTTGGCGACGAGACG |
| mAsPCR-seg76.8..Recoded | GCGACGGCGGAAAATTCA |

TABLE 4-continued

MASC primers (SEQ ID NOS 175-2262, respectively, in order of appearance) used for analysis of recoded segments.

| Primer | Sequence |
| --- | --- |
| mAsPCR-seg76.8..Reverse | TCGACAGACAACCGATCACTTT |
| mAsPCR-seg76.8..Wild-Type | GCGACGGCGGAAAATAGC |
| mAsPCR-seg77.1..Recoded | GTTATCACCAAGAAACAGACCTGA |
| mAsPCR-seg77.1..Reverse | CGGAGAAAGTCAACGCGTTT |
| mAsPCR-seg77.1..Wild-Type | GTTATCACCAAGAAACAGACCGCT |
| mAsPCR-seg77.2..Recoded | AAAAGCGTCGAAAAGTGGTTGG |
| mAsPCR-seg77.2..Reverse | GCAGCCCTATACCATCACC |
| mAsPCR-seg77.2..Wild-Type | AAAAGCGTCGAAAAGTGGTTAC |
| mAsPCR-seg77.3..Recoded | CCGACAATACTGGAGATGAATATGTCT |
| mAsPCR-seg77.3..Reverse | CCACACATCCAGGCCCATAAT |
| mAsPCR-seg77.3..Wild-Type | CCGACAATACTGGAGATGAATATGAGC |
| mAsPCR-seg77.4..Recoded | GGTTCGGCACTATTCCTGTTTCTA |
| mAsPCR-seg77.4..Reverse | CGTGAGCGCCTGAAACAC |
| mAsPCR-seg77.4..Wild-Type | GGTTCGGCACTATTCCTGTTTTTG |
| mAsPCR-seg77.5..Recoded | CTTCACATCCTGAGTATCCTTACCG |
| mAsPCR-seg77.5..Reverse | GCTTTTCTCACTGGCGGGTA |
| mAsPCR-seg77.5..Wild-Type | CTTCACATCCTGAGTATCTTTACCA |
| mAsPCR-seg77.6..Recoded | ACCCACACCGAAGAAAATGAGTAG |
| mAsPCR-seg77.6..Reverse | GCGAATGATCTAACAAACATGCATCAT |
| mAsPCR-seg77.6..Wild-Type | ACCCACACCGAAGAAAATCAACAA |
| mAsPCR-seg77.7..Recoded | CAAAATCAGCAGGAAAAAACCTTTATCGATC |
| mAsPCR-seg77.7..Reverse | CCCTTGCTCATATAGATAATTTACTGCATC |
| mAsPCR-seg77.7..Wild-Type | CAAAATCAGCAGGAAAAAACCTTTATCGATT |
| mAsPCR-seg77.8..Recoded | GTAGAATCACCATCTAATCCACTCCTT |
| mAsPCR-seg77.8..Reverse | GACCGTTCAGATATTTCGTGCAT |
| mAsPCR-seg77.8..Wild-Type | GTAGAAAGGCCAAGTAATCCATTGTTA |
| mAsPCR-seg78.1..Recoded | CAGTAGGTTCACGAAGAAGTCATTT |
| mAsPCR-seg78.1..Reverse | GTGCCTGGTTCAAACTGACG |
| mAsPCR-seg78.1..Wild-Type | CAGCAAGTTCACGAAGAAGTCATTG |
| mAsPCR-seg78.2..Recoded | TCATCGGGATCATGATTTTCAGTGA |
| mAsPCR-seg78.2..Reverse | GCACCACCTCACATACGGT |
| mAsPCR-seg78.2..Wild-Type | TCATCGGGATCATGATTTTCAGGCT |
| mAsPCR-seg78.3..Recoded | CCTGAGTCGCGTCCATAATTTTAAG |
| mAsPCR-seg78.3..Reverse | CGCATCTCATGTAACGTTGTGG |
| mAsPCR-seg78.3..Wild-Type | CCTGAGTCGCGTCCATAATTTTTAA |
| mAsPCR-seg78.4..Recoded | GCTTCGGTATGACGCGTTG |
| mAsPCR-seg78.4..Reverse | CTGCTACTCTCTCGCTGGAAA |

TABLE 4-continued

MASC primers (SEQ ID NOS 175-2262, respectively, in order of appearance) used for analysis of recoded segments.

| Primer | Sequence |
| --- | --- |
| mAsPCR-seg78.4...Wild-Type | GCTTCGGTATGACGCGTGC |
| mAsPCR-seg78.5...Recoded | CATGATGATGACGCTGAAAGGAC |
| mAsPCR-seg78.5...Reverse | CACCTGTGAGAATTTCTGAAGCTC |
| mAsPCR-seg78.5...Wild-Type | CATGATGATGACGCTGAAAGGTT |
| mAsPCR-seg78.6...Recoded | AAGACGTACCACTTTTTCGGCAAG |
| mAsPCR-seg78.6...Reverse | CAATCATCGCACCTTTCCTTACC |
| mAsPCR-seg78.6...Wild-Type | CAAACGTACCACTTTTTCGGCTAA |
| mAsPCR-seg78.7...Recoded | AGTCAGGAGTATTTAGCCTTGGAC |
| mAsPCR-seg78.7...Reverse | CGAGATTCCCCCAGTAGCG |
| mAsPCR-seg78.7...Wild-Type | AGTCAGGAGTATTTAGCCTTGGAG |
| mAsPCR-seg78.8...Recoded | TAATCCATCCCAGACTGAAGGACATTTAG |
| mAsPCR-seg78.8...Reverse | CTGGTGAAGTTTGTTTCCGATCTC |
| mAsPCR-seg78.8...Wild-Type | TAATCCATCCCGCTCTGTAAGACATTTAA |
| mAsPCR-seg79.1...Recoded | AGCGAACATGGAGCTGTCA |
| mAsPCR-seg79.1...Reverse | GAGTCGGGTGCACATCCC |
| mAsPCR-seg79.1...Wild-Type | AGCGAACATGGAGCTGAGC |
| mAsPCR-seg79.2...Recoded | GCCAGAATCCTTCAACGTACTTC |
| mAsPCR-seg79.2...Reverse | TCAGGATCTGCTGACGTTCC |
| mAsPCR-seg79.2...Wild-Type | GCCAGAATCCTTCAACGTATTGT |
| mAsPCR-seg79.3...Recoded | GCGCAGATGGTTTGCACAAG |
| mAsPCR-seg79.3...Reverse | CCCGTGAATCAGCCGCTAT |
| mAsPCR-seg79.3...Wild-Type | GCGCAGATGGTTTGCACTAA |
| mAsPCR-seg79.4...Recoded | CATCGCCCATTCGGTTTTGG |
| mAsPCR-seg79.4...Reverse | TTGACTCCGCAAGTTTGTATTCAAA |
| mAsPCR-seg79.4...Wild-Type | CATCGCCCATTCGGTTTTGC |
| mAsPCR-seg79.5...Recoded | TATTTTTATCGCCGTTGATGCCTCA |
| mAsPCR-seg79.5...Reverse | CCTCTTTCGCCATAACTTGTGC |
| mAsPCR-seg79.5...Wild-Type | TATTTTTATCGCCGTTGATGCCAGT |
| mAsPCR-seg79.6...Recoded | GATACCGGCTTTGTCAGAAACTG |
| mAsPCR-seg79.6...Reverse | GCACAGAGTTATCCACAATCATCAAT |
| mAsPCR-seg79.6...Wild-Type | GATACCGGCTTTGTCAGAAACAC |
| mAsPCR-seg79.7...Recoded | CTCATTAACCGCGACCCAAAG |
| mAsPCR-seg79.7...Reverse | TCAAGGAAAAGACTACGTTAGAATATAAGAA |
| mAsPCR-seg79.7...Wild-Type | CTCATTAACCGCGACCCACAA |
| mAsPCR-seg79.8...Recoded | TTTCCCCGGCACTTATGGAACTT |
| mAsPCR-seg79.8...Reverse | TCTTCAATGGCGTCGCGAA |
| mAsPCR-seg79.8...Wild-Type | TTTCCCCGGCATTAATGGAATTA |
| mAsPCR-seg80.1...Recoded | CTTTATCCATCACGCGAAACTTCTT |

TABLE 4-continued

MASC primers (SEQ ID NOS 175-2262, respectively, in order of appearance) used for analysis of recoded segments.

| Primer | Sequence |
| --- | --- |
| mAsPCR-seg80.1..Reverse | GCCGACCACATTCATGCC |
| mAsPCR-seg80.1..Wild-Type | CTTTATCCATCACGCGAAATTGTTG |
| mAsPCR-seg80.2..Recoded | GAGTTTATTCGCGGCATGTCA |
| mAsPCR-seg80.2..Reverse | GCGTCATTTTCCTGGTCAGC |
| mAsPCR-seg80.2..Wild-Type | GAGTTTATTCGCGGCATGAGT |
| mAsPCR-seg80.3..Recoded | TAGCGTTTTGGCCTCGGAA |
| mAsPCR-seg80.3..Reverse | CAACAAAAATGGGTCACTCAGGATC |
| mAsPCR-seg80.3..Wild-Type | TAGCGTTTTGGCCTCACTG |
| mAsPCR-seg80.4..Recoded | ACATCTTTAACCTTTCACTCCTCCA |
| mAsPCR-seg80.4..Reverse | CGTAATTTTCGCGTATCTGGGT |
| mAsPCR-seg80.4..Wild-Type | ACATCTTTAACCTTTCACACCACCT |
| mAsPCR-seg80.5..Recoded | ACTTGTTAAAGCCCTTCAGGACTGA |
| mAsPCR-seg80.5..Reverse | CTGGGATATTTCTGGTCCTGGTG |
| mAsPCR-seg80.5..Wild-Type | ACTTGTTAAAGCCCTTCAGGACACT |
| mAsPCR-seg80.6..Recoded | ACATCTCCCGCGACGTAC |
| mAsPCR-seg80.6..Reverse | GACGGGTTGGCGGAAAGTA |
| mAsPCR-seg80.6..Wild-Type | ACATCTCCCGCGACGTAT |
| mAsPCR-seg80.7..Recoded | TACAGGTATGCGTTTAAACCCAGTTAAAC |
| mAsPCR-seg80.7..Reverse | CTCAAAGTGGGGGTTAAGAATGTC |
| mAsPCR-seg80.7..Wild-Type | TACAGGTATGCGTTTAAACCCAGTTAAAT |
| mAsPCR-seg80.8..Recoded | AGAAGCAGTACAGGTTTGGTGATA |
| mAsPCR-seg80.8..Reverse | GCCCCTGCCTCAAAAATGG |
| mAsPCR-seg80.8..Wild-Type | AGTAACAGTACAGGTTTGGTGATT |
| mAsPCR-seg81.1..Recoded | CATCTGAATAAAGCGCACTGGTC |
| mAsPCR-seg81.1..Reverse | CGTGCGACCAGTGCAAAG |
| mAsPCR-seg81.1..Wild-Type | CATCTGAATAAAGCGCACTGGAG |
| mAsPCR-seg81.2..Recoded | TGACCACCCACAAAACCTCA |
| mAsPCR-seg81.2..Reverse | GGAATTATACTCCCCAACAGATGAATT |
| mAsPCR-seg81.2..Wild-Type | TGACCACCCACAAAACCAGT |
| mAsPCR-seg81.3..Recoded | GTCACATCACCATCACATACAAAGAAG |
| mAsPCR-seg81.3..Reverse | TTTTCCATGATGGCGAAGTTGAAAT |
| mAsPCR-seg81.3..Wild-Type | GTCACAAGTCCATCACATACAAAGAAA |
| mAsPCR-seg81.4..Recoded | GATCGTCCAAAAGGTTCTGTCT |
| mAsPCR-seg81.4..Reverse | GCGACACCAAGCCAGAAC |
| mAsPCR-seg81.4..Wild-Type | GATCGTCCAAAAGGTTCTGAGC |
| mAsPCR-seg81.5..Recoded | TACTATCTGTGGCAAAACGATTACTCA |
| mAsPCR-seg81.5..Reverse | TCGCCATATTAATCGACTCAACCA |

TABLE 4-continued

MASC primers (SEQ ID NOS 175-2262, respectively, in order of appearance) used for analysis of recoded segments.

| Primer | Sequence |
|---|---|
| mAsPCR-seg81.5..Wild-Type | TACTATCTGTGGCAAAACGATTACAGC |
| mAsPCR-seg81.6..Recoded | GCGAGAATCTCTGCGTGCAC |
| mAsPCR-seg81.6..Reverse | GTTTTTTTGAATAGGGTATGCAGATGGA |
| mAsPCR-seg81.6..Wild-Type | GCGAGAATCTCTGCGTGCAT |
| mAsPCR-seg81.7..Recoded | CAGTAAGCGCAATAACAATACGTGAA |
| mAsPCR-seg81.7..Reverse | TGTAATTTTCCCTCTTCAGCACGA |
| mAsPCR-seg81.7..Wild-Type | CAGTTAACGCAATAACAATCCTGCTC |
| mAsPCR-seg81.8..Recoded | CACCGAAGCCTTCAAAAAGCAT |
| mAsPCR-seg81.8..Reverse | CAACACCCATTGCCATCGT |
| mAsPCR-seg81.8..Wild-Type | CACCGAAGCCTTCAAAAAGCAA |
| mAsPCR-seg82.1..Recoded | GGGCGATATCTTCATACAGTTTTACT |
| mAsPCR-seg82.1..Reverse | CTGGTGTTCGGCATGTCTGA |
| mAsPCR-seg82.1..Wild-Type | GGGCGATATCTTCATACAGTTTCACC |
| mAsPCR-seg82.2..Recoded | CTCTTGATAGCGTGTTGGGTATGA |
| mAsPCR-seg82.2..Reverse | CTGGCGGTGGTTCTCTCC |
| mAsPCR-seg82.2..Wild-Type | CTCTTGATAGCGTGTTGGGTAGCT |
| mAsPCR-seg82.3..Recoded | GGCGCAGAACACCATCTCA |
| mAsPCR-seg82.3..Reverse | CATTTTGTTGACGCAGAGCCA |
| mAsPCR-seg82.3..Wild-Type | GGCGCAGAACACCATCAGT |
| mAsPCR-seg82.4..Recoded | TGTGTATCTGACTCGGTTTACCAAATAAT |
| mAsPCR-seg82.4..Reverse | CGTCATATCATACGCCTGCATTC |
| mAsPCR-seg82.4..Wild-Type | TGTGTAAGTGACAGCGTTTATCAAATTAT |
| mAsPCR-seg82.5..Recoded | GCTTTTTCCCGATCGCCTAG |
| mAsPCR-seg82.5..Reverse | ATTCCTTCATAACCGGGTAAGCAA |
| mAsPCR-seg82.5..Wild-Type | GCTTTTTCCCGATCGCCCAA |
| mAsPCR-seg82.6..Recoded | CAATACCCGGTATCCACTCGTC |
| mAsPCR-seg82.6..Reverse | GTTACCTTTCGCCAGCATGATC |
| mAsPCR-seg82.6..Wild-Type | CAATACCCGGTATCCACTCGTT |
| mAsPCR-seg82.7..Recoded | CCGAGAACAGTACCGCAGA |
| mAsPCR-seg82.7..Reverse | CCCCGGAATCTTCATACAGCA |
| mAsPCR-seg82.7..Wild-Type | CCGAGAACAGTACCGCACT |
| mAsPCR-seg82.8..Recoded | CCAGCCATCAGATTCCGTACG |
| mAsPCR-seg82.8..Reverse | GCACACCACCACTTCTCC |
| mAsPCR-seg82.8..Wild-Type | CCAGCCATCAGATTCCGTTCT |
| mAsPCR-seg83.1..Recoded | CTGTAAAGAGTTTGAGAAATACACCTTCT |
| mAsPCR-seg83.1..Reverse | TTGCTACCATCGCCGGATC |
| mAsPCR-seg83.1..Wild-Type | CTGTAAAGAGTTTGAGAAATACACCTTCA |
| mAsPCR-seg83.2..Recoded | TCAGGAATATCTGAGATTTTGTTGTTTGA |

TABLE 4-continued

MASC primers (SEQ ID NOS 175-2262, respectively, in order of appearance) used for analysis of recoded segments.

| Primer | Sequence |
|---|---|
| mAsPCR-seg83.2..Reverse | CGTACCAGTGACATACCGATAACT |
| mAsPCR-seg83.2..Wild-Type | TCAGGAATATCACTGATTTTGTTGTTGCT |
| mAsPCR-seg83.3..Recoded | CCTGAAAATTGTTCTTTGCCTGA |
| mAsPCR-seg83.3..Reverse | ATGGAACTGCGCGACCTG |
| mAsPCR-seg83.3..Wild-Type | CCGCTAAATTGTTCTTTGCCACT |
| mAsPCR-seg83.4..Recoded | CAGTTACCGCCCAGAGTGA |
| mAsPCR-seg83.4..Reverse | CAGGGCAAAGTAGAATCATCGAAAG |
| mAsPCR-seg83.4..Wild-Type | CAGTTACCGCCCAGAGACT |
| mAsPCR-seg83.5..Recoded | ACGTCAGGATCTCGACCGT |
| mAsPCR-seg83.5..Reverse | CGCGAGGTGTCATCCATAAC |
| mAsPCR-seg83.5..Wild-Type | ACGTCAGGATCTCGACAGA |
| mAsPCR-seg83.6..Recoded | CGCAATATCGGTTATCGCGTAC |
| mAsPCR-seg83.6..Reverse | CCTGGGGAGTCAATCACATCA |
| mAsPCR-seg83.6..Wild-Type | CGCAATATCGGTTATCGCGTAT |
| mAsPCR-seg83.7..Recoded | TATTGGCGATCCTGATTATGCGTTTTC |
| mAsPCR-seg83.7..Reverse | CAGTGTAATTCGAGCCATTCTGC |
| mAsPCR-seg83.7..Wild-Type | TATTGGCGATCCTGATTATGCGTTTAG |
| mAsPCR-seg83.8..Recoded | GGCATACGAACTTGCAGAGA |
| mAsPCR-seg83.8..Reverse | GCTTTTTCAGGCTCTAACGGA |
| mAsPCR-seg83.8..Wild-Type | GGCATACGAACTTGCAGACT |
| mAsPCR-seg84.1..Recoded | GTTGACGGACGCACATAGTAT |
| mAsPCR-seg84.1..Reverse | AACTGGTCTTCACTCGTCGTC |
| mAsPCR-seg84.1..Wild-Type | GTTGACGGACGCACATAGTAG |
| mAsPCR-seg84.2..Recoded | CGTACTTAAAGGTTGTTCAGATTCTTCT |
| mAsPCR-seg84.2..Reverse | CGCAGAGTAAAACGGTAAGCC |
| mAsPCR-seg84.2..Wild-Type | CGTATTGAAAGGTTGTAGCGATAGTAGC |
| mAsPCR-seg84.3..Recoded | AGTACAACAAATCTCAGTCCATCACTC |
| mAsPCR-seg84.3..Reverse | ACAACTTTCAGACCGACCTCTAC |
| mAsPCR-seg84.3..Wild-Type | AGTACAACAAAAGTCAGTCCATCACTT |
| mAsPCR-seg84.4..Recoded | GGTGGTGATCAAGCCCTCA |
| mAsPCR-seg84.4..Reverse | CATCTTTCCCCCAGGCGAA |
| mAsPCR-seg84.4..Wild-Type | GGTGGTGATCAAGCCCAGC |
| mAsPCR-seg84.5..Recoded | CATCCATCCCTCCGTTCTCA |
| mAsPCR-seg84.5..Reverse | CTCTACGGCCTTTAGTCAGTCTATG |
| mAsPCR-seg84.5..Wild-Type | CATCCATCCCTCCGTTCAGC |
| mAsPCR-seg84.6..Recoded | GATGCCACACGCCAGTTT |
| mAsPCR-seg84.6..Reverse | GATAAAGATCGGCGGCATTACG |

TABLE 4-continued

MASC primers (SEQ ID NOS 175-2262, respectively, in order of appearance) used for analysis of recoded segments.

| Primer | Sequence |
| --- | --- |
| mAsPCR-seg84.6...Wild-Type | GATGCCACACGCCAGTTC |
| mAsPCR-seg84.7...Recoded | TGGAGTTCAAATTTACCCCGTTTAAG |
| mAsPCR-seg84.7...Reverse | ACGAAGAAATACCCATAACAATAAATGAAT |
| mAsPCR-seg84.7...Wild-Type | TGGAGTTCAAATTTACCCCGTTTTAA |
| mAsPCR-seg84.8...Recoded | CTGAATCTGACGGCGGAACTA |
| mAsPCR-seg84.8...Reverse | ACGGGTAAAGATGGGGTTTATCAT |
| mAsPCR-seg84.8...Wild-Type | CTGAATCTGACGGCGGAATTG |
| mAsPCR-seg85.1...Recoded | CTTTCTCGATCAGGTCTATCAAGTTTC |
| mAsPCR-seg85.1...Reverse | TCAATCAGGCGGATGATCTCG |
| mAsPCR-seg85.1...Wild-Type | CTTTCTCGATCAGGTCTATCAGGTCAG |
| mAsPCR-seg85.2...Recoded | GAAATGCCGGTGGTCTTGG |
| mAsPCR-seg85.2...Reverse | GGCGTCATCACCTTGATCGA |
| mAsPCR-seg85.2...Wild-Type | CTAATGCCGGTGGTCTTGC |
| mAsPCR-seg85.3...Recoded | CCTCGAAATCCCGTGACAACTC |
| mAsPCR-seg85.3...Reverse | TTTTTTAATGAATTTGCGGTTGAAAAATC |
| mAsPCR-seg85.3...Wild-Type | CCAGTAAATCCCGTGACAACAG |
| mAsPCR-seg85.4...Recoded | CAATCTCGCCATTGTGACGT |
| mAsPCR-seg85.4...Reverse | GAAACAGAAAGTGATCGTCAAACATCT |
| mAsPCR-seg85.4...Wild-Type | CAATCTCGCCATTGTGACGC |
| mAsPCR-seg85.5...Recoded | TGTACTACCATATATTAATGAACAGCGTCTT |
| mAsPCR-seg85.5...Reverse | GCAAGAAAATGGCGGAAGAATT |
| mAsPCR-seg85.5...Wild-Type | TGTATTACCATATATTAATGAACAGCGTTTA |
| mAsPCR-seg85.6...Recoded | CTACCTGCCAATTCATCATCATCA |
| mAsPCR-seg85.6...Reverse | ATACAGATGAATCGTACGCGTTTAG |
| mAsPCR-seg85.6...Wild-Type | CTACCTGCCAATAGTTCAAGTAGT |
| mAsPCR-seg85.7...Recoded | CCACGACGATGCAGGAAG |
| mAsPCR-seg85.7...Reverse | GCTAAGATAATTATACTCAACGGATTCACC |
| mAsPCR-seg85.7...Wild-Type | CCACGACGATGCAGGCAC |
| mAsPCR-seg85.8...Recoded | GCCCGACACCTGAATCTACTAG |
| mAsPCR-seg85.8...Reverse | GCTGTTTATTGCCATTGTTATTGCG |
| mAsPCR-seg85.8...Wild-Type | GCCCGACACCGCTATCTACTAA |
| mAsPCR-seg86.1...Recoded | GTATACCCATCATCTGCTGGAATCT |
| mAsPCR-seg86.1...Reverse | GCCCACTTTATCCCAATCCG |
| mAsPCR-seg86.1...Wild-Type | GTATACCCATCATCTGCTGGAAAGC |
| mAsPCR-seg86.2...Recoded | GCATTGTTCATGTTATCTGCTGAAAG |
| mAsPCR-seg86.2...Reverse | GGTAAATCCGTACTTATCATCACCGT |
| mAsPCR-seg86.2...Wild-Type | GCATTGTTCATGTTATCTGCGCTTAA |
| mAsPCR-seg86.3...Recoded | TCACAAACAGAACGTGGATCTTCT |

TABLE 4-continued

MASC primers (SEQ ID NOS 175-2262, respectively, in order of appearance) used for analysis of recoded segments.

| Primer | Sequence |
|---|---|
| mAsPCR-seg86.3..Reverse | CGGGAGGGGGCATCATTTAA |
| mAsPCR-seg86.3..Wild-Type | TCACAAACAGAACGTGGATCTTCA |
| mAsPCR-seg86.4..Recoded | CGTCGATTCTCAGGCACAATCA |
| mAsPCR-seg86.4..Reverse | GCTGGACTGGCTTTGGATAAAATT |
| mAsPCR-seg86.4..Wild-Type | CGTCGATTCTCAGGCACAAAGT |
| mAsPCR-seg86.5..Recoded | TGATGGACGTGAAAGTGGGTTC |
| mAsPCR-seg86.5..Reverse | AGCACCGCCTGTAGTTTCG |
| mAsPCR-seg86.5..Wild-Type | TGATGGACGTGAAAGTGGGTAG |
| mAsPCR-seg86.6..Recoded | CTTCAGAGATTCGTTCCTGACCT |
| mAsPCR-seg86.6..Reverse | GGCTGGAACAAAACCGTCTG |
| mAsPCR-seg86.6..Wild-Type | CTTCAGAGATTCGTTCCTGACCG |
| mAsPCR-seg86.7..Recoded | GGATAAACCGACGCTTATGTCA |
| mAsPCR-seg86.7..Reverse | TGGTAGGCATTCTTAAGCAGGTC |
| mAsPCR-seg86.7..Wild-Type | GGATAAACCGACGTTGATGAGC |
| mAsPCR-seg86.8..Recoded | CAGAAAGATCGCCGGTACCT |
| mAsPCR-seg86.8..Reverse | CGTGGTATTGGTGTGGTGAAAG |
| mAsPCR-seg86.8..Wild-Type | CAGAAAGATCGCCGGTACCG |

TABLE 5

Summary of AGR codons changed by location in the genome, and failure rates by pool.

| AGR pool | # AGR codon | # Successful | # Failed | % Success |
|---|---|---|---|---|
| AGR.1 | 11 | 10 | 1 | 91 |
| AGR.2 | 12 | 10 | 2 | 83 |
| AGR.3 | 10 | 10 | 0 | 100 |
| AGR.4 | 7 | 7 | 0 | 100 |
| AGR.5 | 14 | 13 | 1 | 93 |
| AGR.6 | 8 | 8 | 0 | 100 |
| AGR.7 | 13 | 11 | 2 | 85 |
| AGR.8 | 9 | 8 | 1 | 89 |
| AGR.9 | 10 | 9 | 1 | 90 |
| AGR.10 | 13 | 12 | 1 | 92 |
| AGR.11 | 7 | 6 | 1 | 86 |
| AGR.12 | 9 | 6 | 3 | 67 |
| Total | 123 | 110 | 13 | 89 |

REFERENCES

The specification identifies the references by author with the complete citations provided below. The disclosure of each reference cited is hereby incorporated by reference in its entirety.

1. Gibson, D. G., Glass, J. I., Lartigue, C., Noskov, V. N., Chuang, R. Y., Algire, M. A., Benders, G. A., Montague, M. G., Ma, L., Moodie, M. M., et al. (2010). Creation of a bacterial cell controlled by a chemically synthesized genome. Science 329, 52-56.
2. Lajoie, M. J., Kosuri, S., Mosberg, J. A., Gregg, C. J., Zhang, D., and Church, G. M. (2013a). Probing the limits of genetic recoding in essential genes. Science 342, 361-363.
3. Lajoie, M. J., Rovner, A. J., Goodman, D. B., Aerni, H. R., Haimovich, A. D., Kuznetsov, G., Mercer, J. A., Wang, H. H., Carr, P. A., Mosberg, J. A., et al. (2013b). Genomically recoded organisms expand biological functions. Science 342, 357-360.
4. Crick, F. H. (1963). On the genetic code. Science 139, 461-464.
5. Liu, C. C., Schultz, P. G. Adding new chemistries to the genetic code. Annu. Rev. Biochem. 79, 413-444 (2010).
6. P. Marliere, The farther, the safer: a manifesto for securely navigating synthetic species away from the old living world. Syst. Synth. Biol. 3, 77-84 (2009).
7. Mandell, D. J. et al., Biocontainment of genetically modified organisms by synthetic protein design. Nature. 518, 55-60 (2015).
8. Rovner, A. J. et al., Recoded organisms engineered to depend on synthetic amino acids. Nature. 518, 89-93 (2015).
9. A. Ambrogelly, S. Palioura, D. Söll, Natural expansion of the genetic code. Nat. Chem. Biol. 3, 29-35 (2007).
10. A. Kano, Y. Andachi, T. Ohama, S. Osawa, Novel anticodon composition of transfer RNAs in Micrococcus luteus, a bacterium with a high genomic G+C content. Correlation with codon usage. J. Mol. Biol. 221, 387-401 (1991).
11. T. Oba, Y. Andachi, A. Muto, S. Osawa, CGG: an unassigned or nonsense codon in Mycoplasma capricolum. Proc. Natl. Acad. Sci. U.S.A. 88, 921-925 (1991).

12. G. Macino, G. Coruzzi, F. G. Nobrega, M. Li, A. Tzagoloff, Use of the UGA terminator as a tryptophan codon in yeast mitochondria. *Proc. Natl. Acad. Sci. U.S.A.* 76, 3784-3785 (1979).
13. J. Ling, P. O'Donoghue, D. Söll, Genetic code flexibility in microorganisms: novel mechanisms and impact on physiology. *Nat. Rev. Microbiol.* 13, 707-721 (2015).
14. K. J. Blight, A. A. Kolykhalov, C. M. Rice, Efficient initiation of HCV RNA replication in cell culture. *Science.* 290, 1972-1974 (2000).
15. J. Cello, A. V. Paul, E. Wimmer, Chemical synthesis of poliovirus cDNA: generation of infectious virus in the absence of natural template. *Science.* 297, 1016-1018 (2002).
16. H. O. Smith, C. A. Hutchison, C. Pfannkoch, J. C. Venter, Generating a synthetic genome by whole genome assembly: φX174 bacteriophage from synthetic oligonucleotides. *Proceedings of the National Academy of Sciences.* 100, 15440-15445 (2003).
17. L. Y. Chan, S. Kosuri, D. Endy, Refactoring bacteriophage T7. *Mol. Syst. Biol.* 1, 2005.0018 (2005).
18. D. G. Gibson et al., Complete chemical synthesis, assembly, and cloning of a *Mycoplasma genitalium* genome. *Science.* 319, 1215-1220 (2008).
19. N. Annaluru et al., Total synthesis of a functional designer eukaryotic chromosome. *Science.* 344, 55-58 (2014).
20. G. Kudla, A. W. Murray, D. Tollervey, J. B. Plotkin, Coding-sequence determinants of gene expression in *Escherichia coli*. *Science.* 324, 255-258 (2009).
21. T. Tuller, Y. Y. Waldman, M. Kupiec, E. Ruppin, Translation efficiency is determined by both codon bias and folding energy. *Proc. Natl. Acad. Sci. U.S.A.* 107, 3645-3650 (2010).
22. J. B. Plotkin, G. Kudla, Synonymous but not the same: the causes and consequences of codon bias. *Nat. Rev. Genet.* 12, 32-42 (2011).
23. D. B. Goodman, G. M. Church, S. Kosuri, Causes and effects of N-terminal codon bias in bacterial genes. *Science.* 342, 475-479 (2013).
24. M. Zhou et al., Non-optimal codon usage affects expression, structure and function of clock protein FRQ. *Nature.* 495, 111-115 (2013).
25. T. E. F. Quax, N. J. Claassens, D. Söll, J. van der Oost, Codon Bias as a Means to Fine-Tune Gene Expression. *Mol. Cell.* 59, 149-161 (2015).
26. G. Boël et al., Codon influence on protein expression in *E. coli* correlates with mRNA levels. *Nature.* 529, 358-363 (2016).
27. F. J. Isaacs et al., Precise manipulation of chromosomes in vivo enables genome-wide codon replacement. *Science.* 333, 348-353 (2011).
28. H. H. Wang et al., Programming cells by multiplex genome engineering and accelerated evolution. *Nature.* 460, 894-898 (2009).
29. K. M. Esvelt et al., Orthogonal Cas9 proteins for RNA-guided gene regulation and editing. *Nat. Methods.* 10, 1116-1121 (2013).
30. G. Pósfai et al., Emergent properties of reduced-genome *Escherichia coli*. *Science.* 312, 1044-1046 (2006).
31. K. Temme, D. Zhao, C. A. Voigt, Refactoring the nitrogen fixation gene cluster from *Klebsiella oxytoca*. *Proc. Natl. Acad. Sci. U.S.A* 109, 7085-7090 (2012).
32. A. H. Yona et al., tRNA genes rapidly change in evolution to meet novel translational demands. *Elife.* 2, e01339 (2013).
33. Y. Yamazaki, H. Niki, J.-I. Kato, in *Microbial Gene Essentiality: Protocols and Bioinformatics*, A. L. Osterman, S. Y. Gerdes, Eds. (Humana Press, Totowa, N.J., 2008), vol. 416 of *Methods in Molecular Biology*™, pp. 385-389.
34. S. Anders, W. Huber, Differential expression analysis for sequence count data. *Genome Biol.* 11, R106 (2010).
35. S. Osawa, T. H. Jukes, Codon reassignment (codon capture) in evolution. *J. Mol. Evol.* 28, 271-278 (1989).
36. H. M. Salis, The ribosome binding site calculator. *Methods Enzymol.* 498, 19-42 (2011).
37. T. Conway et al., Unprecedented high-resolution view of bacterial operon architecture revealed by RNA sequencing. *MBio.* 5, e01442-14 (2014).
38. C. J. Gregg et al., Rational optimization of tolC as a powerful dual selectable marker for genome engineering. *Nucleic Acids Res.* 42, 4779-4790 (2014).
39. K. A. Datsenko, B. L. Wanner, One-step inactivation of chromosomal genes in *Escherichia coli* K-12 using PCR products. *Proc. Natl. Acad. Sci. U.S.A* 97, 6640-6645 (2000).
40. A. Haldimann, B. L. Wanner, Conditional-replication, integration, excision, and retrieval plasmid-host systems for gene structure-function studies of bacteria. *J. Bacteriol.* 183, 6384-6393 (2001).
41. D. E. Deatherage, J. E. Barrick, Identification of mutations in laboratory-evolved microbes from next-generation sequencing data using breseq. *Methods Mol. Biol.* 1151, 165-188 (2014).
42. H. Li, R. Durbin, Fast and accurate short read alignment with Burrows-Wheeler transform. *Bioinformatics.* 25, 1754-1760 (2009a).
43. H. Li et al., The Sequence Alignment/Map format and SAMtools. *Bioinformatics.* 25, 2078-2079 (2009b).
44. S. Anders, W. Huber, Differential expression analysis for sequence count data. *Genome Biol.* 11, R106 (2010).
45. Carr P A, et al. (2012) Enhanced multiplex genome engineering through co-operative oligonucleotide co-selection. *Nucleic Acids Res* 40(17):e132
46. Lennox E S (1955) Transduction of linked genetic characters of the host by bacteriophage P1. *Virology* 1(2):190-206.
47. Schwartz S A & Helinski D R (1971) Purification and characterization of colicin E1. *The Journal of biological chemistry* 246(20):6318-6327.
48. Mosberg J A, Gregg C J, Lajoie M J, Wang H H, & Church G M (2012) Improving Lambda Red Genome Engineering in *Escherichia coli* via Rational Removal of Endogenous Nucleases. *PLoS One* 7(9):e44638.
49. Yaung S J, Esvelt K M, & Church G M (2014) CRISPR/Cas9-mediated phage resistance is not impeded by the DNA modifications of phage T4. *PLoS One* 9(6):e98811.
50. Gibson D G, et al. (2009) Enzymatic assembly of DNA molecules up to several hundred kilobases. *Nat Methods* 6(5):343-345.
51. Baba T, et al. (2006) Construction of *Escherichia coli* K-12 in-frame, single-gene knockout mutants: the Keio collection. *Mol Syst Biol* 2:2006 0008.
52. Hashimoto M, et al. (2005) Cell size and nucleoid organization of engineered *Escherichia coli* cells with a reduced genome. *Mol Microbiol* 55(1):137-149.
53. Ellis H M, Yu D, DiTizio T, & Court D L (2001) High efficiency mutagenesis, repair, and engineering of chromosomal DNA using single-stranded oligonucleotides. *Proc Natl Acad Sci USA* 98(12):6742-6746.

54. Markham N R & Zuker M (2008) UNAFold: software for nucleic acid folding and hybridization *Methods in molecular biology* 453:3-31.
55. Rohland N & Reich D (2012) Cost-effective, high-throughput DNA sequencing libraries for multiplexed target capture. *Genome research* 22(5):939-946.
56. Zadeh J N, el al. (2011) NUPACK: Analysis and design of nucleic acid systems. *J Comput Chem* 32(1):170-173.
57. Li G W, Oh E, & Weissman J S (2012) The anti-Shine-Dalgarno sequence drives translational pausing and codon choice in bacteria. *Nature* 484(7395):538-541.
58. Chen G F & Inouye M (1990) Suppression of the negative effect of minor arginine codons on gene expression; preferential usage of minor codons within the first 25 codons of the *Escherichia coli* genes. *Nucleic Acids Res* 18(6):1465-1473.
59. Rosenberg A H, Goldman E, Dunn J J, Studier F W, & Zubay G (1993) Effects of consecutive AGG codons on translation in *Escherichia coli*, demonstrated with a versatile codon test system. *J Bacteriol* 175(3):716-722.
60. Spanjaard R A & van Duin J (1988) Translation of the sequence AGG-AGG yields 50% ribosomal frameshift. *Proc Natl Acad Sci USA* 85(21):7967-7971.
61. Spanjaard R A, Chen K, Walker J R, & van Duin J (1990) Frameshift suppression at tandem AGA and AGG codons by cloned tRNA genes: assigning a codon to argU tRNA and T4 tRNA(Arg). *Nucleic Acids Res* 18(17):5031-5036.
62. Bonekamp F, Andersen H D, Christensen T, & Jensen K F (1985) Codon-defined ribosomal pausing in *Escherichia coli* detected by using the pyrE attenuator to probe the coupling between transcription and translation. *Nucleic Acids Res* 13(11):4113-4123.
63. Zeng Y, Wang W, & Liu W R (2014) Towards reassigning the rare AGG codon in *Escherichia coli*. *Chembiochem: a European journal of chemical biology* 15(12): 1750-1754.
64. Yu D, et al. (2000) An efficient recombination system for chromosome engineering in *Escherichia coli*. *Proc Natl Acad Sci USA* 97(11):5978-5983.
65. Lajoie M J, Gregg C J, Mosberg J A, Washington G C, & Church G M (2012) Manipulating replisome dynamics to enhance lambda Red-mediated multiplex genome engineering. *Nucleic Acids Res* 40(22):e170.
66. Curran J F (1993) Analysis of effects of tRNA:message stability on frameshift frequency at the *Escherichia coli* RF2 programmed frameshift site. *Nucleic Acids Res* 21(8):1837-1843.
67. Ohtake K, et al. (2012) Efficient decoding of the UAG triplet as a full-fledged sense codon enhances the growth of a prfA-deficient strain of *Escherichia coli*. I 194(10): 2606-2613.
68. Craigen W J, Cook R G, Tate W P, & Caskey C T (1985) Bacterial peptide chain release factors: conserved primary structure and possible frameshift regulation of release factor 2. *Proc Natl Acad Sci USA* 82(11):3616-3620.
69. Goodman D, Kuznetsov, G., Lajoie, M., Ahern, B., (2015) Millstone, a web based genome engineering and analysis software.
70. Novoa E M & Ribas de Pouplana L (2012) Speeding with control: codon usage, tRNAs, and ribosomes. *Trends in genetics*: TIG 28(11):574-581.
71. Novoa E M, Pavon-Eternod M, Pan T, & Ribas de Pouplana L (2012) A role for tRNA modifications in genome structure and codon usage. *Cell* 149(1):202-213.
72. Ikemura T (1985) Codon usage and tRNA content in unicellular and multicellular organisms. *Mol Biol Evol* 2(1):13-34.
73. Lajoie M J, Soll D, & Church G M (2015) Overcoming challenges in engineering the genetic code. *J Mol Biol*.
74. N. R. Markham, M. Zuker, DINAMelt web server for nucleic acid melting prediction. *Nucleic Acids Res.* 33, W577-81 (2005).

SEQUENCE LISTING (2330 sequences)

SEQ ID NO: 1 - DNA, 71 bp, Artificial Sequence
  Description of Artificial Sequence: Synthetic primer
gaaaaaaatatcaccaaataaaaaacgccttagtaagtatttttcctgatccttcaactcagcaaaagttc

SEQ ID NO: 2 - DNA, 71 bp, Artificial Sequence
  Description of Artificial Sequence: Synthetic primer
caattgaccgcagccggaaaacggtaaaagcacctttatattgtgctgatccttcaactcagcaaaagttc

SEQ ID NO: 3 - DNA, 71 bp, Artificial Sequence
  Description of Artificial Sequence: Synthetic primer
aaatacgcgccaggtgaatttccctctggcgcgtagagtacgggactgatccttcaactcagcaaaagttc

SEQ ID NO: 4 - DNA, 71 bp, Artificial Sequence
  Description of Artificial Sequence: Synthetic primer
tacaccgagaaagccgatggggtgattttccagactgcggtttaactgatccttcaactcagcaaaagttc

SEQ ID NO: 5 - DNA, 71 bp, Artificial Sequence
  Description of Artificial Sequence: Synthetic primer
aaatcaaaaaattacctgctttattctggtgataaaattcacgatctgatccttcaactcagcaaaagttc

SEQ ID NO: 6 - DNA, 71 bp, Artificial Sequence
  Description of Artificial Sequence: Synthetic primer
tgcgatttaatgttctccataatgagcaaaattctgaccggtgtactgatccttcaactcagcaaaagttc

SEQ ID NO: 7 - DNA, 71 bp, Artificial Sequence
  Description of Artificial Sequence: Synthetic primer
tgcgaacgttacggcgtctgacctacatgttcatgccggatgcggctgatccttcaactcagcaaaagttc

SEQ ID NO: 8 - DNA, 71 bp, Artificial Sequence
  Description of Artificial Sequence: Synthetic primer
gaaagccggacgtaaccgcaccgaagtggcggcctgacgtccggcctgatccttcaactcagcaaaagttc

SEQ ID NO: 9 - DNA, 71 bp, Artificial Sequence
  Description of Artificial Sequence: Synthetic primer
gggagtgctgaaggagtctgggcgggcaattggtataaccaatgtctgatccttcaactcagcaaaagttc

SEQ ID NO: 10 - DNA, 71 bp, Artificial Sequence
  Description of Artificial Sequence: Synthetic primer
tcatctgcactttccgcaaattatctcgccattaaccgtttcagcctgatccttcaactcagcaaaagttc

SEQ ID NO: 11 - DNA, 71 bp, Artificial Sequence
  Description of Artificial Sequence: Synthetic primer
gcctacaaccggtgccgcatccggcaattggtgcacaatgcctgactgatccttcaactcagcaaaagttc

SEQ ID NO: 12 - DNA, 71 bp, Artificial Sequence
  Description of Artificial Sequence: Synthetic primer
attttcgccagacgccgccgcaggtgacagcgtccgacagttaatctgatccttcaactcagcaaaagttc

SEQ ID NO: 13 - DNA, 71 bp, Artificial Sequence
  Description of Artificial Sequence: Synthetic primer
aatcggctttcgaaagtgggctatcatcccaccccgcgccgcagactgatccttcaactcagcaaaagttc

SEQ ID NO: 14 - DNA, 71 bp, Artificial Sequence
  Description of Artificial Sequence: Synthetic primer
aattgcctgatgcgctacgcttatcaggcctacgaggatggtgcactgatccttcaactcagcaaaagttc

SEQ ID NO: 15 - DNA, 71 bp, Artificial Sequence
  Description of Artificial Sequence: Synthetic primer
cgtctctttttatctttaattgccaaccgaaactaatttcagcctctgatccttcaactcagcaaaagttc

SEQ ID NO: 16 - DNA, 71 bp, Artificial Sequence
  Description of Artificial Sequence: Synthetic primer
cgcttatcaggcctacattttctccgcaatatattgaatttgcgcctgatccttcaactcagcaaaagttc

SEQ ID NO: 17 - DNA, 71 bp, Artificial Sequence
  Description of Artificial Sequence: Synthetic primer
ccgtaacagtgtaataacaatgtgacgcagagcacaaattatattctgatccttcaactcagcaaaagttc

SEQ ID NO: 18 - DNA, 71 bp, Artificial Sequence
  Description of Artificial Sequence: Synthetic primer
cgatcgctctgaaagcgttctacgataataatgatatcctttcaactgatccttcaactcagcaaaagttc

SEQ ID NO: 19 - DNA, 71 bp, Artificial Sequence
  Description of Artificial Sequence: Synthetic primer
ggactgatattcccgctgctggcgcgtaaagcgaatagtaaataactgatccttcaactcagcaaaagttc

SEQ ID NO: 20 - DNA, 71 bp, Artificial Sequence
  Description of Artificial Sequence: Synthetic primer
aagataactaaagcactggcttgataaataaccgaatggcggcaactgatccttcaactcagcaaaagttc

SEQ ID NO: 21 - DNA, 71 bp, Artificial Sequence
  Description of Artificial Sequence: Synthetic primer
cagtcttatgaatatcgcaatcggcgaatacctctggtcgtagagctgatccttcaactcagcaaaagttc

SEQ ID NO: 22 - DNA, 71 bp, Artificial Sequence
  Description of Artificial Sequence: Synthetic primer
atataaaaaatatttcggtgtagtcctttcgtcatgtaaaacgttctgatccttcaactcagcaaaagttc

SEQ ID NO: 23 - DNA, 71 bp, Artificial Sequence
  Description of Artificial Sequence: Synthetic primer
tgtcatgtaaaccaaacagagaatgtcttttcagcgcattcgcagctgatccttcaactcagcaaaagttc

SEQ ID NO: 24 - DNA, 71 bp, Artificial Sequence
  Description of Artificial Sequence: Synthetic primer
ctgatttactgagggtcaaataaatatagcggcaggaaaaaagcgctgatccttcaactcagcaaaagttc

SEQ ID NO: 25 - DNA, 71 bp, Artificial Sequence
  Description of Artificial Sequence: Synthetic primer
atttgccgtgtggttagtcgctttacatcggtaagggtagggattctgatccttcaactcagcaaaagttc

SEQ ID NO: 26 - DNA, 71 bp, Artificial Sequence
  Description of Artificial Sequence: Synthetic primer
cttgcgtactagttaactagttcgatgattaattgtcaacagctcctgatccttcaactcagcaaaagttc

SEQ ID NO: 27 - DNA, 71 bp, Artificial Sequence
  Description of Artificial Sequence: Synthetic primer
atcctggcatgttgctgttgattcttcaatcagatctttataaatctgatccttcaactcagcaaaagttc

SEQ ID NO: 28 - DNA, 71 bp, Artificial Sequence
  Description of Artificial Sequence: Synthetic primer
ccgaaatgattcaggcgacagcctgaacgtagcagggatccacgtctgatccttcaactcagcaaaagttc

SEQ ID NO: 29 - DNA, 71 bp, Artificial Sequence
  Description of Artificial Sequence: Synthetic primer
ggggcttttatcgtctttgctttaccgccagggcgtcggcctcaactgatccttcaactcagcaaaagttc

SEQ ID NO: 30 - DNA, 71 bp, Artificial Sequence
  Description of Artificial Sequence: Synthetic primer
tggcatttccgcgtctgtttattgttgcccggcgtatggagtaaactgatccttcaactcagcaaaagttc

SEQ ID NO: 31 - DNA, 71 bp, Artificial Sequence
  Description of Artificial Sequence: Synthetic primer
caccttagaacgccggataaagactgataattgtcttcgacggtcctgatccttcaactcagcaaaagttc

SEQ ID NO: 32 - DNA, 71 bp, Artificial Sequence
  Description of Artificial Sequence: Synthetic primer
tcgcaacttgagcaagcaccaccgcaaggtacgctggcctcttaactgatccttcaactcagcaaaagttc

SEQ ID NO: 33 - DNA, 71 bp, Artificial Sequence
  Description of Artificial Sequence: Synthetic primer
atagtaagtgactggggtgaacgaacgtagccgcagcacatgcaactgatccttcaactcagcaaaagttc

SEQ ID NO: 34 - DNA, 71 bp, Artificial Sequence
  Description of Artificial Sequence: Synthetic primer
atcatgattagcaaaacttaaccattttaaaataaataaacaattctgatccttcaactcagcaaaagttc

SEQ ID NO: 35 - DNA, 71 bp, Artificial Sequence
  Description of Artificial Sequence: Synthetic primer
tgggtctgttacaggttgatggaaggcggggcgcaaaaagagcaactgatccttcaactcagcaaaagttc

SEQ ID NO: 36 - DNA, 71 bp, Artificial Sequence
  Description of Artificial Sequence: Synthetic primer
atgcaatgaataaaaagttatatcactttttctcataaaacagtcctgatccttcaactcagcaaaagttc

SEQ ID NO: 37 - DNA, 71 bp, Artificial Sequence
  Description of Artificial Sequence: Synthetic primer
gcaatcttctcttttctgaatttgccacctatcatagacaggtgcctgatccttcaactcagcaaaagttc

SEQ ID NO: 38 - DNA, 71 bp, Artificial Sequence
  Description of Artificial Sequence: Synthetic primer
taataagctaacccgcattgagttaaccaataacggattccatacctgatccttcaactcagcaaaagttc

SEQ ID NO: 39 - DNA, 71 bp, Artificial Sequence
  Description of Artificial Sequence: Synthetic primer
acaatatttaatatagtgtctccacatgcgatatttcttaaataactgatccttcaactcagcaaaagttc

SEQ ID NO: 40 - DNA, 71 bp, Artificial Sequence
  Description of Artificial Sequence: Synthetic primer
gataaaccatcagctgatagtttacctgaagaatatagagaagtactgatccttcaactcagcaaaagttc

SEQ ID NO: 41 - DNA, 71 bp, Artificial Sequence
  Description of Artificial Sequence: Synthetic primer
ctttttaaaattcgttcttccatgcccggtaacgctccagaaaacctgatccttcaactcagcaaaagttc

SEQ ID NO: 42 - DNA, 71 bp, Artificial Sequence
  Description of Artificial Sequence: Synthetic primer
agaaccagattgatgcattgagctttcatcctatgaaattaattgctgatccttcaactcagcaaaagttc

SEQ ID NO: 43 - DNA, 71 bp, Artificial Sequence
  Description of Artificial Sequence: Synthetic primer
tttttacgggcacagccaaactttaccgtgccctaatacgacaaactgatccttcaactcagcaaaagttc

SEQ ID NO: 44 - DNA, 71 bp, Artificial Sequence
  Description of Artificial Sequence: Synthetic primer
accaaactgattagacattctcgttctccatttgcgtaaaacctgctgatccttcaactcagcaaaagttc

SEQ ID NO: 45 - DNA, 71 bp, Artificial Sequence
  Description of Artificial Sequence: Synthetic primer
tgacgacaacagtaacattcaacgttaaatatgttaataagacgtctgatccttcaactcagcaaaagttc

SEQ ID NO: 46 - DNA, 71 bp, Artificial Sequence
  Description of Artificial Sequence: Synthetic primer
ttgcaatacaattcttacgcctgtaggattagtaagaagacttatctgatccttcaactcagcaaaagttc

SEQ ID NO: 47 - DNA, 71 bp, Artificial Sequence
  Description of Artificial Sequence: Synthetic primer
ccggttatccgcatcaagaagtaattcttgccgcagtgaaaaatgctgatccttcaactcagcaaaagttc

SEQ ID NO: 48 - DNA, 71 bp, Artificial Sequence
  Description of Artificial Sequence: Synthetic primer
ttcagtataaaagggcatgataatttacattaactcctttttttcctgatccttcaactcagcaaaagttc

SEQ ID NO: 49 - DNA, 71 bp, Artificial Sequence
  Description of Artificial Sequence: Synthetic primer
gccgcggcattatacagagcgtaaccgattgcatctaccccttttctgatccttcaactcagcaaaagttc

SEQ ID NO: 50 - DNA, 71 bp, Artificial Sequence
  Description of Artificial Sequence: Synthetic primer
cctcctgtagggtttttattaacaacggcttattctaattattttctgatccttcaactcagcaaaagttc

SEQ ID NO: 51 - DNA, 71 bp, Artificial Sequence
  Description of Artificial Sequence: Synthetic primer
caaccccgtcctgtacggggtttgttttttggaggccacgttttgctgatccttcaactcagcaaaagttc

SEQ ID NO: 52 - DNA, 71 bp, Artificial Sequence
  Description of Artificial Sequence: Synthetic primer
ttcaggcgttttttcgctatctttgacaaaaaatatcaactttctctgatccttcaactcagcaaaagttc

SEQ ID NO: 53 - DNA, 71 bp, Artificial Sequence
  Description of Artificial Sequence: Synthetic primer
tttattgttattaaagagatttttaagctaaagatgaatttcgtcctgatccttcaactcagcaaaagttc

SEQ ID NO: 54 - DNA, 71 bp, Artificial Sequence
  Description of Artificial Sequence: Synthetic primer
ttgtaggccgcacgccacatccgacattcagcgcctgatgcgacgctgatccttcaactcagcaaaagttc

SEQ ID NO: 55 - DNA, 71 bp, Artificial Sequence
  Description of Artificial Sequence: Synthetic primer
aatggcggcgaaaatcagcataaaacggctggtcatggtcgtaccctgatccttcaactcagcaaaagttc

SEQ ID NO: 56 - DNA, 71 bp, Artificial Sequence
  Description of Artificial Sequence: Synthetic primer
atcacaaaggaaatatgcctgagcagcagtcagagacataactggctgatccttcaactcagcaaaagttc

SEQ ID NO: 57 - DNA, 71 bp, Artificial Sequence
  Description of Artificial Sequence: Synthetic primer
tatggtcactcatttgatccattatgccttattgtgccgtgactactgatccttcaactcagcaaaagttc

SEQ ID NO: 58 - DNA, 71 bp, Artificial Sequence
  Description of Artificial Sequence: Synthetic primer
cccgctgacgaaggcaaacccatagacatgtcgtcagacatagcgctgatccttcaactcagcaaaagttc

SEQ ID NO: 59 - DNA, 71 bp, Artificial Sequence
  Description of Artificial Sequence: Synthetic primer
atttattcccctcgcgtcccgcccgttgttactcttccttgttcactgatccttcaactcagcaaaagttc

SEQ ID NO: 60 - DNA, 71 bp, Artificial Sequence
  Description of Artificial Sequence: Synthetic primer
ggagaaagcctcgtgtatactcctcacccttataaaagtccctttctgatccttcaactcagcaaaagttc

SEQ ID NO: 61 - DNA, 71 bp, Artificial Sequence
  Description of Artificial Sequence: Synthetic primer
aacaacccgtaggccggacaagatgcgccagcatcgcatccggcactgatccttcaactcagcaaaagttc

SEQ ID NO: 62 - DNA, 71 bp, Artificial Sequence
  Description of Artificial Sequence: Synthetic primer
atggcgatgagtgtttccattgctgttctcttttatactgtgggcctgatccttcaactcagcaaaagttc

SEQ ID NO: 63 - DNA, 71 bp, Artificial Sequence
  Description of Artificial Sequence: Synthetic primer
ctgaaatcgttctcaatcaacgtcatttgtacattttgtgcgcttctgatccttcaactcagcaaaagttc

SEQ ID NO: 64 - DNA, 71 bp, Artificial Sequence
  Description of Artificial Sequence: Synthetic primer
tgacgacgcggagaaccggaagctaaatacagagaagtcatagaactgatccttcaactcagcaaaagttc

SEQ ID NO: 65 - DNA, 71 bp, Artificial Sequence
  Description of Artificial Sequence: Synthetic primer
ttccatgctgaaaagcccgttttcaggatactcaaatggaaacgcctgatccttcaactcagcaaaagttc

SEQ ID NO: 66 - DNA, 71 bp, Artificial Sequence
  Description of Artificial Sequence: Synthetic primer
catccggcgatgctggcgcgttgaattttacatcccgtacgttccctgatccttcaactcagcaaaagttc

SEQ ID NO: 67 - DNA, 71 bp, Artificial Sequence
  Description of Artificial Sequence: Synthetic primer
taagtaaaggagtgaaacagtttcataagtaaaatatccagtgtgctgatccttcaactcagcaaaagttc

SEQ ID NO: 68 - DNA, 71 bp, Artificial Sequence
  Description of Artificial Sequence: Synthetic primer
ttgaactgctggcctggcagaagaaatttaaagttaaaaaataacctgatccttcaactcagcaaaagttc

SEQ ID NO: 69 - DNA, 71 bp, Artificial Sequence
  Description of Artificial Sequence: Synthetic primer
cattcgtcatcaatttgaacaacacaatactgacccacattcccgctgatccttcaactcagcaaaagttc

SEQ ID NO: 70 - DNA, 71 bp, Artificial Sequence
  Description of Artificial Sequence: Synthetic primer
accacagcaaagggaaaaagtgtggggaaagagtgtgcatgaagcctgatccttcaactcagcaaaagttc

SEQ ID NO: 71 - DNA, 71 bp, Artificial Sequence
  Description of Artificial Sequence: Synthetic primer
acgtgactggcgaaatcttcgccagtcggtaacagctttacgacactgatccttcaactcagcaaaagttc

SEQ ID NO: 72 - DNA, 71 bp, Artificial Sequence
  Description of Artificial Sequence: Synthetic primer
aggcgctgatggcgaagttagcgtagcgtttatgccggatggtatctgatccttcaactcagcaaaagttc

SEQ ID NO: 73 - DNA, 71 bp, Artificial Sequence
  Description of Artificial Sequence: Synthetic primer
ccgctggcgacgcggatgtcgcatcaggggcagcccgtttaagcgctgatccttcaactcagcaaaagttc

SEQ ID NO: 74 - DNA, 71 bp, Artificial Sequence
  Description of Artificial Sequence: Synthetic primer
cgtctaaacataatatccctttatggtgcaaagaaagaattaacgctgatccttcaactcagcaaaagttc

SEQ ID NO: 75 - DNA, 71 bp, Artificial Sequence
  Description of Artificial Sequence: Synthetic primer
aattatttgtcgttatgatttaaatgttttgttttacactctgtcctgatccttcaactcagcaaaagttc

SEQ ID NO: 76 - DNA, 71 bp, Artificial Sequence
  Description of Artificial Sequence: Synthetic primer
cgctattacagcaatatttttcgtgatgaacgtgccggaaagcgactgatccttcaactcagcaaaagttc

SEQ ID NO: 77 - DNA, 71 bp, Artificial Sequence
  Description of Artificial Sequence: Synthetic primer
atcagattcaccgatatcgcctcttttattgtgggattgaccctgctgatccttcaactcagcaaaagttc

SEQ ID NO: 78 - DNA, 71 bp, Artificial Sequence
  Description of Artificial Sequence: Synthetic primer
gcaggacttattcatttcgtgaattttattattttatttataaacctgatccttcaactcagcaaaagttc

SEQ ID NO: 79 - DNA, 71 bp, Artificial Sequence
  Description of Artificial Sequence: Synthetic primer
atggttagtttatatttgcagtccggtttgctttgcataccggatctgatccttcaactcagcaaaagttc

SEQ ID NO: 80 - DNA, 71 bp, Artificial Sequence
  Description of Artificial Sequence: Synthetic primer
accagaacctggctcatcagtgattttctttgtcataatcattgcctgatccttcaactcagcaaaagttc

SEQ ID NO: 81 - DNA, 71 bp, Artificial Sequence
  Description of Artificial Sequence: Synthetic primer
ccgtaaaagtttcggtggaatgagatcttgcgattttgttaataactgatccttcaactcagcaaaagttc

SEQ ID NO: 82 - DNA, 71 bp, Artificial Sequence
  Description of Artificial Sequence: Synthetic primer
aataaatgcgtgaaaaactttacttgcaatagaacttgatacttcctgatccttcaactcagcaaaagttc

SEQ ID NO: 83 - DNA, 71 bp, Artificial Sequence
  Description of Artificial Sequence: Synthetic primer
caccccaatggggagagggagaaaacgagcgcaatattcaatatcctgatccttcaactcagcaaaagttc

SEQ ID NO: 84 - DNA, 71 bp, Artificial Sequence
  Description of Artificial Sequence: Synthetic primer
tttctgtaagtgagaacttgaggttttttattaacacatcaggatctgatccttcaactcagcaaaagttc

SEQ ID NO: 85 - DNA, 71 bp, Artificial Sequence
  Description of Artificial Sequence: Synthetic primer
aacagactgatcgaggtcatttttgagtgcaaaaagtgctgtaacctgatccttcaactcagcaaaagttc

SEQ ID NO: 86 - DNA, 71 bp, Artificial Sequence
  Description of Artificial Sequence: Synthetic primer
gaataaggtgtgtttatttatcgcgggcataaaaaaacccttactctgatccttcaactcagcaaaagttc

SEQ ID NO: 87 - DNA, 71 bp, Artificial Sequence
  Description of Artificial Sequence: Synthetic primer
gtgatgaagatcacgtcagaaaattgttacattactatgttacgcctgatccttcaactcagcaaaagttc

SEQ ID NO: 88 - DNA, 75 bp, Artificial Sequence
  Description of Artificial Sequence: Synthetic primer
tgcatatattccccaaatcgacacacggatatcagggctatctccttattagaaaaactcatcgagcatcaaatg

SEQ ID NO: 89 - DNA, 75 bp, Artificial Sequence
  Description of Artificial Sequence: Synthetic primer
atagtcaggaatagtcttatttactttaagcatattgatgtccagttattagaaaaactcatcgagcatcaaatg

SEQ ID NO: 90 - DNA, 75 bp, Artificial Sequence
  Description of Artificial Sequence: Synthetic primer
tcaccgggcattgtgtcgtttatgcgcagcgcgtgcgctgactttttattagaaaaactcatcgagcatcaaatg

SEQ ID NO: 91 - DNA, 75 bp, Artificial Sequence
  Description of Artificial Sequence: Synthetic primer
cgtctgaactgccgcccggaagtaacgatgctggaactggtgtagttattagaaaaactcatcgagcatcaaatg

SEQ ID NO: 92 - DNA, 75 bp, Artificial Sequence
  Description of Artificial Sequence: Synthetic primer
cactctttcaacgagcaattgtatattgttatgtaagcaagtgctttattagaaaaactcatcgagcatcaaatg

SEQ ID NO: 93 - DNA, 75 bp, Artificial Sequence
  Description of Artificial Sequence: Synthetic primer
cctacagattcttgcgccattcgtaggccggataaggcgttcacgttattagaaaaactcatcgagcatcaaatg

SEQ ID NO: 94 - DNA, 75 bp, Artificial Sequence
  Description of Artificial Sequence: Synthetic primer
gtgtatggaaaaatcagaaaaactcagcaaatcctgatgactttcttattagaaaaactcatcgagcatcaaatg

SEQ ID NO: 95 - DNA, 75 bp, Artificial Sequence
  Description of Artificial Sequence: Synthetic primer
ttgtcactctaatgataattatttgttaaataattgttttatttcttattagaaaaactcatcgagcatcaaatg

SEQ ID NO: 96 - DNA, 75 bp, Artificial Sequence
  Description of Artificial Sequence: Synthetic primer
aaacgataccaccaacaggcgattgcctcaagaaaggcacctgggttattagaaaaactcatcgagcatcaaatg

SEQ ID NO: 97 - DNA, 75 bp, Artificial Sequence
  Description of Artificial Sequence: Synthetic primer
atccggtacccattgtaggcctgataagatgcgtcaagcatcgcattattagaaaaactcatcgagcatcaaatg

SEQ ID NO: 98 - DNA, 75 bp, Artificial Sequence
  Description of Artificial Sequence: Synthetic primer
cagcgccatgcaagtgctggataggcttaaggcgctgttttaagcttattagaaaaactcatcgagcatcaaatg

SEQ ID NO: 99 - DNA, 75 bp, Artificial Sequence
  Description of Artificial Sequence: Synthetic primer
cagacacgactttgtagaaattgttttacaaaaatggcgatgcaattattagaaaaactcatcgagcatcaaatg

SEQ ID NO: 100 - DNA, 75 bp, Artificial Sequence
  Description of Artificial Sequence: Synthetic primer
gtgaacgccttatccggcctacaaaatcgcttaaattcaatatatttattagaaaaactcatcgagcatcaaatg

SEQ ID NO: 101 - DNA, 75 bp, Artificial Sequence
  Description of Artificial Sequence: Synthetic primer
taaggtaactttagtgacatttatgtttaaaatgtgtgagttatattattagaaaaactcatcgagcatcaaatg

SEQ ID NO: 102 - DNA, 75 bp, Artificial Sequence
  Description of Artificial Sequence: Synthetic primer
gtttatgccggatgcggcgtgaacgccttatccggcctacaaaccttattagaaaaactcatcgagcatcaaatg

SEQ ID NO: 103 - DNA, 75 bp, Artificial Sequence
  Description of Artificial Sequence: Synthetic primer
ggctaaatcattcacatcatcaatttcatccttactttcattcgattattagaaaaactcatcgagcatcaaatg

SEQ ID NO: 104 - DNA, 75 bp, Artificial Sequence
  Description of Artificial Sequence: Synthetic primer
ctaagccttcgatctcaaaagcattatcagactgatacgctattattattagaaaaactcatcgagcatcaaatg

SEQ ID NO: 105 - DNA, 75 bp, Artificial Sequence
  Description of Artificial Sequence: Synthetic primer
aaaacgggtcagatctgccagagtcagcgtcaccgaccacaataattattagaaaaactcatcgagcatcaaatg

SEQ ID NO: 106 - DNA, 75 bp, Artificial Sequence
  Description of Artificial Sequence: Synthetic primer
actcgcctgagaaaacaggggtaaattccccgaatggcggcgctattattagaaaaactcatcgagcatcaaatg

SEQ ID NO: 107 - DNA, 75 bp, Artificial Sequence
  Description of Artificial Sequence: Synthetic primer
agaaaaataacccgataatggtagatctccctctttatcctgaaattattagaaaaactcatcgagcatcaaatg

SEQ ID NO: 108 - DNA, 75 bp, Artificial Sequence
  Description of Artificial Sequence: Synthetic primer
ttttgcagtaaaaaattgtccacggaggtgtggagaaaaaacaagttattagaaaaactcatcgagcatcaaatg

SEQ ID NO: 109 - DNA, 75 bp, Artificial Sequence
  Description of Artificial Sequence: Synthetic primer
aaatcgttttgctgccgtatatatcgccattattcccatttctgcttattagaaaaactcatcgagcatcaaatg

SEQ ID NO: 110 - DNA, 75 bp, Artificial Sequence
  Description of Artificial Sequence: Synthetic primer
acgtgatctgttcggtcgctaatccattcggcgctcctgcgggagttattagaaaaactcatcgagcatcaaatg

SEQ ID NO: 111 - DNA, 75 bp, Artificial Sequence
  Description of Artificial Sequence: Synthetic primer
tacagtgacttcataaaaattatgagatttttcacggtgctgtaattattagaaaaactcatcgagcatcaaatg

SEQ ID NO: 112 - DNA, 75 bp, Artificial Sequence
  Description of Artificial Sequence: Synthetic primer
ttttttgcgccgacatcataacggttctggcaaatattctgaaatttattagaaaaactcatcgagcatcaaatg

SEQ ID NO: 113 - DNA, 75 bp, Artificial Sequence
  Description of Artificial Sequence: Synthetic primer
gctgaactgttaatacaatttgcgtgccaattttttatctttttgttattagaaaaactcatcgagcatcaaatg

SEQ ID NO: 114 - DNA, 75 bp, Artificial Sequence
  Description of Artificial Sequence: Synthetic primer
aatcgctgacagaaaccgatattgacatcctccacgccctgaaggttattagaaaaactcatcgagcatcaaatg

SEQ ID NO: 115 - DNA, 75 bp, Artificial Sequence
  Description of Artificial Sequence: Synthetic primer
accattgcctgcgcaatggtgtttttgtttttatctgctttatacttattagaaaaactcatcgagcatcaaatg

SEQ ID NO: 116 - DNA, 75 bp, Artificial Sequence
  Description of Artificial Sequence: Synthetic primer
tccagcaaaaattcttcccgatcgtcattaccagctgacgtgatattattagaaaaactcatcgagcatcaaatg

SEQ ID NO: 117 - DNA, 75 bp, Artificial Sequence
  Description of Artificial Sequence: Synthetic primer
aatgttaagtagtgattcgtgccggggcgatgtctcgttttacccttattagaaaaactcatcgagcatcaaatg

SEQ ID NO: 118 - DNA, 75 bp, Artificial Sequence
  Description of Artificial Sequence: Synthetic primer
ctgggcggtggcggtgaacgctatgcctgtggtgtaattaagtaattattagaaaaactcatcgagcatcaaatg

SEQ ID NO: 119 - DNA, 75 bp, Artificial Sequence
  Description of Artificial Sequence: Synthetic primer
aacaactcaggcaacacgcaaacgatttactcgtcgtatttcaagttattagaaaaactcatcgagcatcaaatg

SEQ ID NO: 120 - DNA, 75 bp, Artificial Sequence
  Description of Artificial Sequence: Synthetic primer
tgcctttgacgatctattgctataaataagtgatcttttttctttttattagaaaaactcatcgagcatcaaatg

SEQ ID NO: 121 - DNA, 75 bp, Artificial Sequence
  Description of Artificial Sequence: Synthetic primer
tgaacttaagtctcagacctatttggccggtaatccctctcgaatttattagaaaaactcatcgagcatcaaatg

SEQ ID NO: 122 - DNA, 75 bp, Artificial Sequence
  Description of Artificial Sequence: Synthetic primer
ctttggggattgacttctctttagggtaattaatagccgttaactttattagaaaaactcatcgagcatcaaatg

SEQ ID NO: 123 - DNA, 75 bp, Artificial Sequence
  Description of Artificial Sequence: Synthetic primer
cgtacagcgcgcttaccatacaaactccctttaaaatggccgatgttattagaaaaactcatcgagcatcaaatg

SEQ ID NO: 124 - DNA, 75 bp, Artificial Sequence
  Description of Artificial Sequence: Synthetic primer
agcaatggcgtgagcacaggtatctttctctgttggccgtattgtttattagaaaaactcatcgagcatcaaatg

SEQ ID NO: 125 - DNA, 75 bp, Artificial Sequence
  Description of Artificial Sequence: Synthetic primer
ataacctcacattatccctgaattaaaagtggtaataataaaacattattagaaaaactcatcgagcatcaaatg

SEQ ID NO: 126 - DNA, 75 bp, Artificial Sequence
  Description of Artificial Sequence: Synthetic primer
gtgaaaaggggttagatagtaccaaatgggaaaatgttaagtaagttattagaaaaactcatcgagcatcaaatg

SEQ ID NO: 127 - DNA, 75 bp, Artificial Sequence
  Description of Artificial Sequence: Synthetic primer
aatcacttttgccgaggtaacagcgtcataacaacaattaaagccttattagaaaaactcatcgagcatcaaatg

SEQ ID NO: 128 - DNA, 75 bp, Artificial Sequence
  Description of Artificial Sequence: Synthetic primer
gggtatggagctatgggtattttctgtacccaatgcttttaacagttattagaaaaactcatcgagcatcaaatg

SEQ ID NO: 129 - DNA, 75 bp, Artificial Sequence
  Description of Artificial Sequence: Synthetic primer
tctcccttgtttgaattgaaaagtccaggctgcaaagtctgggctttattagaaaaactcatcgagcatcaaatg

SEQ ID NO: 130 - DNA, 75 bp, Artificial Sequence
  Description of Artificial Sequence: Synthetic primer
gaggtaattcaggcgtaatcaacaacccttgtctatagttagtgattattagaaaaactcatcgagcatcaaatg

SEQ ID NO: 131 - DNA, 75 bp, Artificial Sequence
  Description of Artificial Sequence: Synthetic primer
ttcaaccgctatacctgctatcttcaacttcaggacaataatgcattattagaaaaactcatcgagcatcaaatg

SEQ ID NO: 132 - DNA, 75 bp, Artificial Sequence
  Description of Artificial Sequence: Synthetic primer
aaaatcagggattgtaccgatgatttatagtttcaagttggcactttattagaaaaactcatcgagcatcaaatg

SEQ ID NO: 133 - DNA, 75 bp, Artificial Sequence
  Description of Artificial Sequence: Synthetic primer
ttgccgccgctggcggaagcataaaaaaatggcgccgatgggcgcttattagaaaaactcatcgagcatcaaatg

SEQ ID NO: 134 - DNA, 75 bp, Artificial Sequence
  Description of Artificial Sequence: Synthetic primer
cttgacttgcttcactgtagcggcaaggtacgagccaatcgtggattattagaaaaactcatcgagcatcaaatg

SEQ ID NO: 135 - DNA, 75 bp, Artificial Sequence
  Description of Artificial Sequence: Synthetic primer
agtcgatagtaacccgcccttcggggatagcaagcattttttgcattattagaaaaactcatcgagcatcaaatg

SEQ ID NO: 136 - DNA, 75 bp, Artificial Sequence
  Description of Artificial Sequence: Synthetic primer
ctattaactgtaatatttgagcggcacgcgctgccgctcatcacattattagaaaaactcatcgagcatcaaatg

SEQ ID NO: 137 - DNA, 75 bp, Artificial Sequence
  Description of Artificial Sequence: Synthetic primer
gctgcatccagaaagtaacaatagcgaacagacaaaaagaatacgttattagaaaaactcatcgagcatcaaatg

SEQ ID NO: 138 - DNA, 75 bp, Artificial Sequence
  Description of Artificial Sequence: Synthetic primer
caaatcgccggaatttcccgtgatataagggctgagagcaaatcgttattagaaaaactcatcgagcatcaaatg

SEQ ID NO: 139 - DNA, 75 bp, Artificial Sequence
  Description of Artificial Sequence: Synthetic primer
gcggtgaataatgtcgatgatgtcgaaatgacacgtcgacacggcttattagaaaaactcatcgagcatcaaatg

SEQ ID NO: 140 - DNA, 75 bp, Artificial Sequence
  Description of Artificial Sequence: Synthetic primer
acggttctggcctggggacttgtaggcctgataagacgcgtcaagttattagaaaaactcatcgagcatcaaatg

SEQ ID NO: 141 - DNA, 75 bp, Artificial Sequence
  Description of Artificial Sequence: Synthetic primer
gaacaagaaaaattccgctttcgttatgaacaataatttacgtagttattagaaaaactcatcgagcatcaaatg

SEQ ID NO: 142 - DNA, 75 bp, Artificial Sequence
  Description of Artificial Sequence: Synthetic primer
tatctacccctctattggtgggttagtggttgcaaaccttacgtgttattagaaaaactcatcgagcatcaaatg

SEQ ID NO: 143 - DNA, 75 bp, Artificial Sequence
  Description of Artificial Sequence: Synthetic primer
ctcgattctgctgtggcttttgcggctagtgtatcagaatcgcttttattagaaaaactcatcgagcatcaaatg

SEQ ID NO: 144 - DNA, 75 bp, Artificial Sequence
  Description of Artificial Sequence: Synthetic primer
cgatagtcgttaactgttttacacttaataaaataatttgaggttttattagaaaaactcatcgagcatcaaatg

SEQ ID NO: 145 - DNA, 75 bp, Artificial Sequence
  Description of Artificial Sequence: Synthetic primer
agagcttccggctctgcatgatgatgtccttatatttggcattccttattagaaaaactcatcgagcatcaaatg

SEQ ID NO: 146 - DNA, 75 bp, Artificial Sequence
  Description of Artificial Sequence: Synthetic primer
ttactgcaattgctgctgctttgtaaagcaccgcggccttttttgttattagaaaaactcatcgagcatcaaatg

SEQ ID NO: 147 - DNA, 75 bp, Artificial Sequence
  Description of Artificial Sequence: Synthetic primer
gattatggcgagcaaggccagataaacgccaggttttggggatcgttattagaaaaactcatcgagcatcaaatg

SEQ ID NO: 148 - DNA, 75 bp, Artificial Sequence
  Description of Artificial Sequence: Synthetic primer
taaagaaaccagggtgtcatcgtctgcgtcgcatgttaaggtcagttattagaaaaactcatcgagcatcaaatg

SEQ ID NO: 149 - DNA, 75 bp, Artificial Sequence
  Description of Artificial Sequence: Synthetic primer
aaacaatgcctcttaaggttttcttaaggttcttctgaaagtgaattattagaaaaactcatcgagcatcaaatg

SEQ ID NO: 150 - DNA, 75 bp, Artificial Sequence
  Description of Artificial Sequence: Synthetic primer
tgctgatgcgcaaagtccgtcagcagtttgcagtgcaataaaggtttattagaaaaactcatcgagcatcaaatg

SEQ ID NO: 151 - DNA, 75 bp, Artificial Sequence
  Description of Artificial Sequence: Synthetic primer
gggttgagctggctagattagccagccaatcttttgtatgtctgtttattagaaaaactcatcgagcatcaaatg

SEQ ID NO: 152 - DNA, 75 bp, Artificial Sequence
  Description of Artificial Sequence: Synthetic primer
actgaacggtcccctcgcccctttggggagagggttagggtgaggttattagaaaaactcatcgagcatcaaatg

SEQ ID NO: 153 - DNA, 75 bp, Artificial Sequence
  Description of Artificial Sequence: Synthetic primer
atctaaaaagatgatcttaataaatctattaagaatgagatggagttattagaaaaactcatcgagcatcaaatg

SEQ ID NO: 154 - DNA, 75 bp, Artificial Sequence
  Description of Artificial Sequence: Synthetic primer
gctataaaggaacgcgctttgtcagctttgtaggcgaacaataagttattagaaaaactcatcgagcatcaaatg

SEQ ID NO: 155 - DNA, 75 bp, Artificial Sequence
  Description of Artificial Sequence: Synthetic primer
gactcggcatgtttgggattattaagctgacaattcatacgattattattagaaaaactcatcgagcatcaaatg

SEQ ID NO: 156 - DNA, 75 bp, Artificial Sequence
  Description of Artificial Sequence: Synthetic primer
gtaacgctaaagtctcttttcaaacttgcatttttgtaaatttgtttattagaaaaactcatcgagcatcaaatg

SEQ ID NO: 157 - DNA, 75 bp, Artificial Sequence
  Description of Artificial Sequence: Synthetic primer
tttttcaactatctctgtaacccttgcccgtaaattcgtgatagcttattagaaaaactcatcgagcatcaaatg

SEQ ID NO: 158 - DNA, 75 bp, Artificial Sequence
  Description of Artificial Sequence: Synthetic primer
tttattgtcggcagtgccagaagtaattcatgcgcgccggatggcttattagaaaaactcatcgagcatcaaatg

SEQ ID NO: 159 - DNA, 75 bp, Artificial Sequence
  Description of Artificial Sequence: Synthetic primer
agcatcgttctcccatggagctgatgacgatgctgcggtgacgtgttattagaaaaactcatcgagcatcaaatg

SEQ ID NO: 160 - DNA, 75 bp, Artificial Sequence
  Description of Artificial Sequence: Synthetic primer
aagcaccttaattatcgtcgcattcagaacagtctggatgcgatgttattagaaaaactcatcgagcatcaaatg

SEQ ID NO: 161 - DNA, 75 bp, Artificial Sequence
  Description of Artificial Sequence: Synthetic primer
attctttgaccgagctagttatggcgcggagtattagttacgcttttattagaaaaactcatcgagcatcaaatg

SEQ ID NO: 162 - DNA, 75 bp, Artificial Sequence
  Description of Artificial Sequence: Synthetic primer
gggtgaaacagtcagtttccgctaagattgcatgccggataagccttattagaaaaactcatcgagcatcaaatg

SEQ ID NO: 163 - DNA, 75 bp, Artificial Sequence
  Description of Artificial Sequence: Synthetic primer
tacatttcatagtgatgctccttactcttgagacagacacgttagttattagaaaaactcatcgagcatcaaatg

SEQ ID NO: 164 - DNA, 75 bp, Artificial Sequence
  Description of Artificial Sequence: Synthetic primer
gtgaacataataaatgaaaaaagaaaacgccactacacgcattttttattagaaaaactcatcgagcatcaaatg

SEQ ID NO: 165 - DNA, 75 bp, Artificial Sequence
  Description of Artificial Sequence: Synthetic primer
aaatcagggaagatgaaaaaacttcaggatggtaagaaaaagaaattattagaaaaactcatcgagcatcaaatg

SEQ ID NO: 166 - DNA, 75 bp, Artificial Sequence
  Description of Artificial Sequence: Synthetic primer
cgtattagcttttcggattatacgccctcaacagagcctgtctcattattagaaaaactcatcgagcatcaaatg

SEQ ID NO: 167 - DNA, 75 bp, Artificial Sequence
  Description of Artificial Sequence: Synthetic primer
cacttttattaactcagcattatttttaaacatcaaaccacttaattattagaaaaactcatcgagcatcaaatg

SEQ ID NO: 168 - DNA, 75 bp, Artificial Sequence
  Description of Artificial Sequence: Synthetic primer
agaaacacagttaaaaattgcaaaagattttttagacctggagaattattagaaaaactcatcgagcatcaaatg

SEQ ID NO: 169 - DNA, 75 bp, Artificial Sequence
  Description of Artificial Sequence: Synthetic primer
caccctaaccctctccccagaggggcgaggggaccgattgtgctcttattagaaaaactcatcgagcatcaaatg

SEQ ID NO: 170 - DNA, 75 bp, Artificial Sequence
  Description of Artificial Sequence: Synthetic primer
cattgtaaacattaaatgtttatcttttcatgatatcaacttgcgttattagaaaaactcatcgagcatcaaatg

SEQ ID NO: 171 - DNA, 75 bp, Artificial Sequence
  Description of Artificial Sequence: Synthetic primer
aatcaccgtttgcttaaaaatggattctaccatcgctttttcagattattagaaaaactcatcgagcatcaaatg

SEQ ID NO: 172 - DNA, 75 bp, Artificial Sequence
  Description of Artificial Sequence: Synthetic primer
aataagttcttctggcgtaataaccctgaacgccgggcttcggttttattagaaaaactcatcgagcatcaaatg

SEQ ID NO: 173 - DNA, 75 bp, Artificial Sequence
  Description of Artificial Sequence: Synthetic primer
tttttttatttctactgataagaattacaaggcacatcacgttatttattagaaaaactcatcgagcatcaaatg

SEQ ID NO: 174 - DNA, 75 bp, Artificial Sequence
  Description of Artificial Sequence: Synthetic primer
atccacacagagacatattgcccgttgcagtcagaatgaaaagctttattagaaaaactcatcgagcatcaaatg

SEQ ID NO: 175 - DNA, 22 bp, Artificial Sequence
  Description of Artificial Sequence: Synthetic primer
caagctagacgaaggcatgtca

SEQ ID NO: 176 - DNA, 23 bp, Artificial Sequence
  Description of Artificial Sequence: Synthetic primer
cgatattttcccgtggttctgac

SEQ ID NO: 177 - DNA, 22 bp, Artificial Sequence
  Description of Artificial Sequence: Synthetic primer
caagttagacgaaggcatgagt

SEQ ID NO: 178 - DNA, 20 bp, Artificial Sequence
  Description of Artificial Sequence: Synthetic primer
cgaccatggcgatcttcagc

SEQ ID NO: 179 - DNA, 26 bp, Artificial Sequence
  Description of Artificial Sequence: Synthetic primer
ttccaggtattacgcagaaattgttc

SEQ ID NO: 180 - DNA, 20 bp, Artificial Sequence
  Description of Artificial Sequence: Synthetic primer
cgaccatggcgatttacagt

SEQ ID NO: 181 - DNA, 24 bp, Artificial Sequence
  Description of Artificial Sequence: Synthetic primer
cttaccgcgcaaaatttcatctca

SEQ ID NO: 182 - DNA, 27 bp, Artificial Sequence
  Description of Artificial Sequence: Synthetic primer
tttttacgcagcactacttgtatatgg

SEQ ID NO: 183 - DNA, 24 bp, Artificial Sequence
  Description of Artificial Sequence: Synthetic primer
ttaaccgcgcaaaatttcatcagc

SEQ ID NO: 184 - DNA, 22 bp, Artificial Sequence
  Description of Artificial Sequence: Synthetic primer
cctgttttcacactaccgttca

SEQ ID NO: 185 - DNA, 27 bp, Artificial Sequence
  Description of Artificial Sequence: Synthetic primer
ttaatttgcatagaccgttttcagagt

SEQ ID NO: 186 - DNA, 22 bp, Artificial Sequence
  Description of Artificial Sequence: Synthetic primer
cctgtttagccactaccgtagc

SEQ ID NO: 187 - DNA, 25 bp, Artificial Sequence
  Description of Artificial Sequence: Synthetic primer
cgggaagtgatgttttatctcaacc

SEQ ID NO: 188 - DNA, 19 bp, Artificial Sequence
  Description of Artificial Sequence: Synthetic primer
actttcgcagtggcttgtg

SEQ ID NO: 189 - DNA, 25 bp, Artificial Sequence
  Description of Artificial Sequence: Synthetic primer
cgggaagtgatgttttatctcaact

SEQ ID NO: 190 - DNA, 23 bp, Artificial Sequence
  Description of Artificial Sequence: Synthetic primer
tgccgtcagggagataattttag

SEQ ID NO: 191 - DNA, 18 bp, Artificial Sequence
  Description of Artificial Sequence: Synthetic primer
ccctgaccaacgccaaag

SEQ ID NO: 192 - DNA, 23 bp, Artificial Sequence
  Description of Artificial Sequence: Synthetic primer
tgccgtcagggagataattttgc

SEQ ID NO: 193 - DNA, 22 bp, Artificial Sequence
  Description of Artificial Sequence: Synthetic primer
caccgatgaaaaacagcccaag

SEQ ID NO: 194 - DNA, 19 bp, Artificial Sequence
  Description of Artificial Sequence: Synthetic primer
cgttttgtagcccgctctg

SEQ ID NO: 195 - DNA, 22 bp, Artificial Sequence
  Description of Artificial Sequence: Synthetic primer
caccgatgaaaaacagccccaa

SEQ ID NO: 196 - DNA, 24 bp, Artificial Sequence
  Description of Artificial Sequence: Synthetic primer
cccgagtgtgtattcaggttcaat

SEQ ID NO: 197 - DNA, 19 bp, Artificial Sequence
  Description of Artificial Sequence: Synthetic primer
cctggacttcggtttcacg

SEQ ID NO: 198 - DNA, 24 bp, Artificial Sequence
  Description of Artificial Sequence: Synthetic primer
cccgagtgtgtattcaggttcaaa

SEQ ID NO: 199 - DNA, 22 bp, Artificial Sequence
  Description of Artificial Sequence: Synthetic primer
cgtctggaagagcacaaagact

SEQ ID NO: 200 - DNA, 26 bp, Artificial Sequence
  Description of Artificial Sequence: Synthetic primer
aaaaagttcaaaaattcgctgtggag

SEQ ID NO: 201 - DNA, 22 bp, Artificial Sequence
  Description of Artificial Sequence: Synthetic primer
cgtctggaagagcacaaagaca

SEQ ID NO: 202 - DNA, 25 bp, Artificial Sequence
  Description of Artificial Sequence: Synthetic primer
tggatctcagatacagaatcagaac

SEQ ID NO: 203 - DNA, 19 bp, Artificial Sequence
  Description of Artificial Sequence: Synthetic primer
agccactgatgctgaaggg

SEQ ID NO: 204 - DNA, 25 bp, Artificial Sequence
  Description of Artificial Sequence: Synthetic primer
tggatcagcgatacagaaagcgaat

SEQ ID NO: 205 - DNA, 20 bp, Artificial Sequence
  Description of Artificial Sequence: Synthetic primer
ggtgcaagcgtaacctgtag

SEQ ID NO: 206 - DNA, 24 bp, Artificial Sequence
  Description of Artificial Sequence: Synthetic primer
gactatttctacggcaccattccc

SEQ ID NO: 207 - DNA, 20 bp, Artificial Sequence
  Description of Artificial Sequence: Synthetic primer
ggtgcaagcgtaacctgcaa

SEQ ID NO: 208 - DNA, 21 bp, Artificial Sequence
  Description of Artificial Sequence: Synthetic primer
cgaccgcgggaaagataatgt

SEQ ID NO: 209 - DNA, 20 bp, Artificial Sequence
  Description of Artificial Sequence: Synthetic primer
ggctgggttggcgttttaaa

SEQ ID NO: 210 - DNA, 21 bp, Artificial Sequence
  Description of Artificial Sequence: Synthetic primer
cgaccgcgggacaaataatga

SEQ ID NO: 211 - DNA, 20 bp, Artificial Sequence
  Description of Artificial Sequence: Synthetic primer
gtggttgcgggtttggttag

SEQ ID NO: 212 - DNA, 18 bp, Artificial Sequence
  Description of Artificial Sequence: Synthetic primer
gctggtccgaagcctacg

SEQ ID NO: 213 - DNA, 20 bp, Artificial Sequence
  Description of Artificial Sequence: Synthetic primer
gtggttgcgggtttggtcaa

SEQ ID NO: 214 - DNA, 23 bp, Artificial Sequence
  Description of Artificial Sequence: Synthetic primer
ccaacctcacgtgacagaaatag

SEQ ID NO: 215 - DNA, 21 bp, Artificial Sequence
  Description of Artificial Sequence: Synthetic primer
ggatgaccgcaattctgaaag

SEQ ID NO: 216 - DNA, 23 bp, Artificial Sequence
  Description of Artificial Sequence: Synthetic primer
ccaacctcacgactcagaaataa

SEQ ID NO: 217 - DNA, 19 bp, Artificial Sequence
  Description of Artificial Sequence: Synthetic primer
gcccgccaggttaaaaact

SEQ ID NO: 218 - DNA, 28 bp, Artificial Sequence
  Description of Artificial Sequence: Synthetic primer
caagaaaattcaacatcatcggtgtaat

SEQ ID NO: 219 - DNA, 19 bp, Artificial Sequence
  Description of Artificial Sequence: Synthetic primer
gcccgccaggttaaaaaca

SEQ ID NO: 220 - DNA, 26 bp, Artificial Sequence
  Description of Artificial Sequence: Synthetic primer
tagtagtgggattgtaagaacgcatc

SEQ ID NO: 221 - DNA, 24 bp, Artificial Sequence
  Description of Artificial Sequence: Synthetic primer
tggttaagcaaacggaagacattc

SEQ ID NO: 222 - DNA, 26 bp, Artificial Sequence
  Description of Artificial Sequence: Synthetic primer
tagtagtgggattgtaagaacgcata

SEQ ID NO: 223 - DNA, 25 bp, Artificial Sequence
  Description of Artificial Sequence: Synthetic primer
ggaagaacatgccaactttatctca

SEQ ID NO: 224 - DNA, 19 bp, Artificial Sequence
  Description of Artificial Sequence: Synthetic primer
ccaccgcgttgttcagttc

SEQ ID NO: 225 - DNA, 25 bp, Artificial Sequence
  Description of Artificial Sequence: Synthetic primer
ggaagaacatgccaactttatcagt

SEQ ID NO: 226 - DNA, 21 bp, Artificial Sequence
  Description of Artificial Sequence: Synthetic primer
gcagatctgattgtcgcctca

SEQ ID NO: 227 - DNA, 21 bp, Artificial Sequence
  Description of Artificial Sequence: Synthetic primer
tgtagttatgctgcccggaaa

SEQ ID NO: 228 - DNA, 21 bp, Artificial Sequence
  Description of Artificial Sequence: Synthetic primer
gcagatctgattgtcgccagt

SEQ ID NO: 229 - DNA, 31 bp, Artificial Sequence
  Description of Artificial Sequence: Synthetic primer
tgaagaagtacttattgaaaaatggctatcg

SEQ ID NO: 230 - DNA, 20 bp, Artificial Sequence
  Description of Artificial Sequence: Synthetic primer
cagcctgacactagcactgt

SEQ ID NO: 231 - DNA, 31 bp, Artificial Sequence
  Description of Artificial Sequence: Synthetic primer
tgaagaagtattgattgaaaaatggctaagt

SEQ ID NO: 232 - DNA, 29 bp, Artificial Sequence
  Description of Artificial Sequence: Synthetic primer
ttttattcacgcgtttatacatttccgat

SEQ ID NO: 233 - DNA, 20 bp, Artificial Sequence
  Description of Artificial Sequence: Synthetic primer
tgcgtaccggtgaaggaaaa

SEQ ID NO: 234 - DNA, 29 bp, Artificial Sequence
  Description of Artificial Sequence: Synthetic primer
ttttattcacgcgtttatacatttccgag

SEQ ID NO: 235 - DNA, 25 bp, Artificial Sequence
  Description of Artificial Sequence: Synthetic primer
gcaatgtatctgccaattttccatc

SEQ ID NO: 236 - DNA, 20 bp, Artificial Sequence
  Description of Artificial Sequence: Synthetic primer
catgtcatccgagtctgcga

SEQ ID NO: 237 - DNA, 25 bp, Artificial Sequence
  Description of Artificial Sequence: Synthetic primer
gcaatgtatctgccaattttccatt

SEQ ID NO: 238 - DNA, 24 bp, Artificial Sequence
  Description of Artificial Sequence: Synthetic primer
ggtgagggcaataatctttacacg

SEQ ID NO: 239 - DNA, 21 bp, Artificial Sequence
  Description of Artificial Sequence: Synthetic primer
tcttgcgggtgtggtatatgc

SEQ ID NO: 240 - DNA, 24 bp, Artificial Sequence
  Description of Artificial Sequence: Synthetic primer
ggtgagggcaataatctttacacc

SEQ ID NO: 241 - DNA, 21 bp, Artificial Sequence
  Description of Artificial Sequence: Synthetic primer
cagcacgaagatggtcactca

SEQ ID NO: 242 - DNA, 22 bp, Artificial Sequence
  Description of Artificial Sequence: Synthetic primer
gataccttcctcagcaccttcc

SEQ ID NO: 243 - DNA, 21 bp, Artificial Sequence
  Description of Artificial Sequence: Synthetic primer
cagcacgaagatggtcacagc

SEQ ID NO: 244 - DNA, 22 bp, Artificial Sequence
  Description of Artificial Sequence: Synthetic primer
gcacatggggtttaaacggtag

SEQ ID NO: 245 - DNA, 27 bp, Artificial Sequence
  Description of Artificial Sequence: Synthetic primer
aaacttcgttaattcgcatggtgataa

SEQ ID NO: 246 - DNA, 22 bp, Artificial Sequence
  Description of Artificial Sequence: Synthetic primer
gcacatggggtttaaacggcaa

SEQ ID NO: 247 - DNA, 21 bp, Artificial Sequence
  Description of Artificial Sequence: Synthetic primer
agagccgaaaagcactgttcg

SEQ ID NO: 248 - DNA, 24 bp, Artificial Sequence
  Description of Artificial Sequence: Synthetic primer
gttttggcagcattagtttcagga

SEQ ID NO: 249 - DNA, 21 bp, Artificial Sequence
  Description of Artificial Sequence: Synthetic primer
gctgccgaataacactgttct

SEQ ID NO: 250 - DNA, 19 bp, Artificial Sequence
  Description of Artificial Sequence: Synthetic primer
ggtggtgcctttgtcgtta

SEQ ID NO: 251 - DNA, 26 bp, Artificial Sequence
  Description of Artificial Sequence: Synthetic primer
gggacgatttaaaccacagataaagt

SEQ ID NO: 252 - DNA, 19 bp, Artificial Sequence
  Description of Artificial Sequence: Synthetic primer
ggtggtgcctttgtcgttt

SEQ ID NO: 253 - DNA, 28 bp, Artificial Sequence
  Description of Artificial Sequence: Synthetic primer
caaaatcaaacagaatattgtgctctga

SEQ ID NO: 254 - DNA, 22 bp, Artificial Sequence
  Description of Artificial Sequence: Synthetic primer
ctggcctatatctctgcactgg

SEQ ID NO: 255 - DNA, 28 bp, Artificial Sequence
  Description of Artificial Sequence: Synthetic primer
caaaatcaaacagaatattgtgctcact

SEQ ID NO: 256 - DNA, 25 bp, Artificial Sequence
  Description of Artificial Sequence: Synthetic primer
tagcatgcgagagtctgagtaaagt

SEQ ID NO: 257 - DNA, 23 bp, Artificial Sequence
  Description of Artificial Sequence: Synthetic primer
attatccctcaggcttctgttcg

SEQ ID NO: 258 - DNA, 25 bp, Artificial Sequence
  Description of Artificial Sequence: Synthetic primer
caacatgcggctgtcactgtataaa

SEQ ID NO: 259 - DNA, 19 bp, Artificial Sequence
  Description of Artificial Sequence: Synthetic primer
ggttacgcagttcgagtga

SEQ ID NO: 260 - DNA, 20 bp, Artificial Sequence
  Description of Artificial Sequence: Synthetic primer
gcctcatttttcccccgaac

SEQ ID NO: 261 - DNA, 19 bp, Artificial Sequence
  Description of Artificial Sequence: Synthetic primer
ggttacgcagttcgaggct

SEQ ID NO: 262 - DNA, 22 bp, Artificial Sequence
  Description of Artificial Sequence: Synthetic primer
cgacttatctgacggccctatc

SEQ ID NO: 263 - DNA, 23 bp, Artificial Sequence
  Description of Artificial Sequence: Synthetic primer
cggatgtagctgatctttcggta

SEQ ID NO: 264 - DNA, 22 bp, Artificial Sequence
  Description of Artificial Sequence: Synthetic primer
cgacttatctgacggccttaag

SEQ ID NO: 265 - DNA, 24 bp, Artificial Sequence
  Description of Artificial Sequence: Synthetic primer
gtggaggatagtcggaatatgatg

SEQ ID NO: 266 - DNA, 20 bp, Artificial Sequence
  Description of Artificial Sequence: Synthetic primer
gccgctaaacagtcctcact

SEQ ID NO: 267 - DNA, 24 bp, Artificial Sequence
  Description of Artificial Sequence: Synthetic primer
gtggaggatagtcggaatagctgc

SEQ ID NO: 268 - DNA, 24 bp, Artificial Sequence
  Description of Artificial Sequence: Synthetic primer
acggtcattaaagttcaactgtca

SEQ ID NO: 269 - DNA, 24 bp, Artificial Sequence
  Description of Artificial Sequence: Synthetic primer
ttaccaatcgctacggtgtaatca

SEQ ID NO: 270 - DNA, 24 bp, Artificial Sequence
  Description of Artificial Sequence: Synthetic primer
acggtcattaaagttcaactgagc

SEQ ID NO: 271 - DNA, 22 bp, Artificial Sequence
  Description of Artificial Sequence: Synthetic primer
tttgtgcgtcgtgaactgaaag

SEQ ID NO: 272 - DNA, 24 bp, Artificial Sequence
  Description of Artificial Sequence: Synthetic primer
ccgtcaactgagctgattttcatc

SEQ ID NO: 273 - DNA, 22 bp, Artificial Sequence
  Description of Artificial Sequence: Synthetic primer
tttgtgcgtcgtgaacacttaa

SEQ ID NO: 274 - DNA, 27 bp, Artificial Sequence
  Description of Artificial Sequence: Synthetic primer
cgtacttcagcatctttacggatatct

SEQ ID NO: 275 - DNA, 21 bp, Artificial Sequence
  Description of Artificial Sequence: Synthetic primer
tctttaccaccgactcagcag

SEQ ID NO: 276 - DNA, 27 bp, Artificial Sequence
  Description of Artificial Sequence: Synthetic primer
cgtacttcagcatcttttctgatatcg

SEQ ID NO: 277 - DNA, 23 bp, Artificial Sequence
  Description of Artificial Sequence: Synthetic primer
acatcgactctacccaagtttca

SEQ ID NO: 278 - DNA, 19 bp, Artificial Sequence
  Description of Artificial Sequence: Synthetic primer
tcaacctggtccggtgaac

SEQ ID NO: 279 - DNA, 23 bp, Artificial Sequence
  Description of Artificial Sequence: Synthetic primer
acatcgactctacccaggtcagt

SEQ ID NO: 280 - DNA, 26 bp, Artificial Sequence
  Description of Artificial Sequence: Synthetic primer
gaagagatcaaagagaaagcgctatc

SEQ ID NO: 281 - DNA, 18 bp, Artificial Sequence
  Description of Artificial Sequence: Synthetic primer
aagtcccagtgcgcgttt

SEQ ID NO: 282 - DNA, 26 bp, Artificial Sequence
  Description of Artificial Sequence: Synthetic primer
gaagagatcaaagagaaagcgttgag

SEQ ID NO: 283 - DNA, 22 bp, Artificial Sequence
  Description of Artificial Sequence: Synthetic primer
cggcaccgcatatcaaaaatct

SEQ ID NO: 284 - DNA, 23 bp, Artificial Sequence
  Description of Artificial Sequence: Synthetic primer
actggcactacatcgttcatcat

SEQ ID NO: 285 - DNA, 22 bp, Artificial Sequence
  Description of Artificial Sequence: Synthetic primer
cggcaccgcatatcaaaaaagc

SEQ ID NO: 286 - DNA, 25 bp, Artificial Sequence
  Description of Artificial Sequence: Synthetic primer
ggcatttactttatcaccgggttag

SEQ ID NO: 287 - DNA, 21 bp, Artificial Sequence
  Description of Artificial Sequence: Synthetic primer
cagctatcatctgtgggcgaa

SEQ ID NO: 288 - DNA, 25 bp, Artificial Sequence
  Description of Artificial Sequence: Synthetic primer
ggcatttactttatcaccgggtcaa

SEQ ID NO: 289 - DNA, 25 bp, Artificial Sequence
  Description of Artificial Sequence: Synthetic primer
gtagtactttgggatttgaggcaag

SEQ ID NO: 290 - DNA, 21 bp, Artificial Sequence
  Description of Artificial Sequence: Synthetic primer
taacctgctctcttcgcgtac

SEQ ID NO: 291 - DNA, 25 bp, Artificial Sequence
  Description of Artificial Sequence: Synthetic primer
gcaatactttgggattgctggctaa

SEQ ID NO: 292 - DNA, 24 bp, Artificial Sequence
  Description of Artificial Sequence: Synthetic primer
cacctcatgaagttgtccatctga

SEQ ID NO: 293 - DNA, 20 bp, Artificial Sequence
  Description of Artificial Sequence: Synthetic primer
gcccgtccgctttttaactc

SEQ ID NO: 294 - DNA, 24 bp, Artificial Sequence
  Description of Artificial Sequence: Synthetic primer
cacctcatgtaattgtccatcgct

SEQ ID NO: 295 - DNA, 22 bp, Artificial Sequence
  Description of Artificial Sequence: Synthetic primer
aaagatcgtgcggaagaatgga

SEQ ID NO: 296 - DNA, 31 bp, Artificial Sequence
  Description of Artificial Sequence: Synthetic primer
cttaagcagatgaaaaccatacattttagtg

SEQ ID NO: 297 - DNA, 22 bp, Artificial Sequence
  Description of Artificial Sequence: Synthetic primer
acaaatcgtgcggaagaatact

SEQ ID NO: 298 - DNA, 30 bp, Artificial Sequence
  Description of Artificial Sequence: Synthetic primer
aagacctataaagcgatggtaaaagatcta

SEQ ID NO: 299 - DNA, 26 bp, Artificial Sequence
  Description of Artificial Sequence: Synthetic primer
gccatattatttttccctgcattcaa

SEQ ID NO: 300 - DNA, 30 bp, Artificial Sequence
  Description of Artificial Sequence: Synthetic primer
aagacctataaagcgatggtaaaagatttg

SEQ ID NO: 301 - DNA, 23 bp, Artificial Sequence
  Description of Artificial Sequence: Synthetic primer
gagttccagttcgctcaaatcga

SEQ ID NO: 302 - DNA, 18 bp, Artificial Sequence
  Description of Artificial Sequence: Synthetic primer
cccaatggctgctaacgc

SEQ ID NO: 303 - DNA, 23 bp, Artificial Sequence
  Description of Artificial Sequence: Synthetic primer
gagttccagttctctcaaatcgt

SEQ ID NO: 304 - DNA, 21 bp, Artificial Sequence
  Description of Artificial Sequence: Synthetic primer
gctctgactgaaccttcacag

SEQ ID NO: 305 - DNA, 20 bp, Artificial Sequence
  Description of Artificial Sequence: Synthetic primer
cgtagtggggatgccagatc

SEQ ID NO: 306 - DNA, 21 bp, Artificial Sequence
  Description of Artificial Sequence: Synthetic primer
gctctgactgaaccttcacgc

SEQ ID NO: 307 - DNA, 20 bp, Artificial Sequence
  Description of Artificial Sequence: Synthetic primer
cggaagaggactcacgcctt

SEQ ID NO: 308 - DNA, 26 bp, Artificial Sequence
  Description of Artificial Sequence: Synthetic primer
catacagccagacaatcgaaaaagaa

SEQ ID NO: 309 - DNA, 20 bp, Artificial Sequence
  Description of Artificial Sequence: Synthetic primer
cggaagaggactcacgctta

SEQ ID NO: 310 - DNA, 27 bp, Artificial Sequence
  Description of Artificial Sequence: Synthetic primer
tctacatgtaatacggttgaaacgcta

SEQ ID NO: 311 - DNA, 20 bp, Artificial Sequence
  Description of Artificial Sequence: Synthetic primer
gagtgttgtgtgccgtgttc

SEQ ID NO: 312 - DNA, 27 bp, Artificial Sequence
  Description of Artificial Sequence: Synthetic primer
agcacatgtaatacggttgaaacgttg

SEQ ID NO: 313 - DNA, 24 bp, Artificial Sequence
  Description of Artificial Sequence: Synthetic primer
atgctctatcgtctacagcaagtt

SEQ ID NO: 314 - DNA, 24 bp, Artificial Sequence
  Description of Artificial Sequence: Synthetic primer
ggtgggtagatgctgagtgataaa

SEQ ID NO: 315 - DNA, 24 bp, Artificial Sequence
  Description of Artificial Sequence: Synthetic primer
atgctctatcgtttacagcaggtc

SEQ ID NO: 316 - DNA, 29 bp, Artificial Sequence
  Description of Artificial Sequence: Synthetic primer
ggtaatttcagaatatggtggacaaaaac

SEQ ID NO: 317 - DNA, 31 bp, Artificial Sequence
  Description of Artificial Sequence: Synthetic primer
attctcttcggtaaaaattgagttcattaaa

SEQ ID NO: 318 - DNA, 29 bp, Artificial Sequence
  Description of Artificial Sequence: Synthetic primer
ggtaatttcagaatatggtggacaaaaat

SEQ ID NO: 319 - DNA, 31 bp, Artificial Sequence
  Description of Artificial Sequence: Synthetic primer
agctgattgtttttaaccgtattaagtatag

SEQ ID NO: 320 - DNA, 18 bp, Artificial Sequence
  Description of Artificial Sequence: Synthetic primer
ctgggggccgatgaagtt

SEQ ID NO: 321 - DNA, 31 bp, Artificial Sequence
  Description of Artificial Sequence: Synthetic primer
aactgattgtttttaaccgtattaagtatgc

SEQ ID NO: 322 - DNA, 19 bp, Artificial Sequence
  Description of Artificial Sequence: Synthetic primer
gattgcagtgagtggctga

SEQ ID NO: 323 - DNA, 23 bp, Artificial Sequence
  Description of Artificial Sequence: Synthetic primer
ttaccgatctagcagaagaagcc

SEQ ID NO: 324 - DNA, 19 bp, Artificial Sequence
  Description of Artificial Sequence: Synthetic primer
gattgcagtgagtggcgct

SEQ ID NO: 325 - DNA, 21 bp, Artificial Sequence
  Description of Artificial Sequence: Synthetic primer
cggaaaggggtactagcactt

SEQ ID NO: 326 - DNA, 20 bp, Artificial Sequence
  Description of Artificial Sequence: Synthetic primer
ggaacgaccgcttttagtgc

SEQ ID NO: 327 - DNA, 21 bp, Artificial Sequence
  Description of Artificial Sequence: Synthetic primer
cggaaaggggtattggcattg

SEQ ID NO: 328 - DNA, 19 bp, Artificial Sequence
  Description of Artificial Sequence: Synthetic primer
ccgtcaaaagctgcgattg

SEQ ID NO: 329 - DNA, 19 bp, Artificial Sequence
  Description of Artificial Sequence: Synthetic primer
tgagcctggcgatctgttc

SEQ ID NO: 330 - DNA, 19 bp, Artificial Sequence
  Description of Artificial Sequence: Synthetic primer
ccgtcaaaagctgcgatgc

SEQ ID NO: 331 - DNA, 21 bp, Artificial Sequence
  Description of Artificial Sequence: Synthetic primer
cggcgggatataacatgacga

SEQ ID NO: 332 - DNA, 21 bp, Artificial Sequence
  Description of Artificial Sequence: Synthetic primer
gcactaggtcaccagcaaatc

SEQ ID NO: 333 - DNA, 21 bp, Artificial Sequence
  Description of Artificial Sequence: Synthetic primer
cggcgggatataacatgagct

SEQ ID NO: 334 - DNA, 20 bp, Artificial Sequence
  Description of Artificial Sequence: Synthetic primer
ccattggacgtttcacctca

SEQ ID NO: 335 - DNA, 18 bp, Artificial Sequence
  Description of Artificial Sequence: Synthetic primer
gcgtccctgctccagaag

SEQ ID NO: 336 - DNA, 20 bp, Artificial Sequence
  Description of Artificial Sequence: Synthetic primer
ccattggacgtttcaccagc

SEQ ID NO: 337 - DNA, 24 bp, Artificial Sequence
  Description of Artificial Sequence: Synthetic primer
ggcgtcattaatttcatccagtga

SEQ ID NO: 338 - DNA, 19 bp, Artificial Sequence
  Description of Artificial Sequence: Synthetic primer
ctggggtcagtcggtgatc

SEQ ID NO: 339 - DNA, 24 bp, Artificial Sequence
  Description of Artificial Sequence: Synthetic primer
ggcgtcattaatttcatccaggct

SEQ ID NO: 340 - DNA, 22 bp, Artificial Sequence
  Description of Artificial Sequence: Synthetic primer
gcgtggttatcagctagtgtca

SEQ ID NO: 341 - DNA, 19 bp, Artificial Sequence
  Description of Artificial Sequence: Synthetic primer
gtgactgcgggcttatcga

SEQ ID NO: 342 - DNA, 22 bp, Artificial Sequence
  Description of Artificial Sequence: Synthetic primer
gcgtggttatcagttggtgagc

SEQ ID NO: 343 - DNA, 21 bp, Artificial Sequence
  Description of Artificial Sequence: Synthetic primer
tgaggctcagttagtgtcgtc

SEQ ID NO: 344 - DNA, 20 bp, Artificial Sequence
  Description of Artificial Sequence: Synthetic primer
tcgatgttcctgtcctgctg

SEQ ID NO: 345 - DNA, 21 bp, Artificial Sequence
  Description of Artificial Sequence: Synthetic primer
tgaggctcagtcaatgtcgtt

SEQ ID NO: 346 - DNA, 19 bp, Artificial Sequence
  Description of Artificial Sequence: Synthetic primer
gctggcgctttcggatcta

SEQ ID NO: 347 - DNA, 19 bp, Artificial Sequence
  Description of Artificial Sequence: Synthetic primer
gcaaagcgccaccagaaat

SEQ ID NO: 348 - DNA, 19 bp, Artificial Sequence
  Description of Artificial Sequence: Synthetic primer
gctggcgctttcggatctg

SEQ ID NO: 349 - DNA, 21 bp, Artificial Sequence
  Description of Artificial Sequence: Synthetic primer
gcccaggacggtaggatatca

SEQ ID NO: 350 - DNA, 18 bp, Artificial Sequence
  Description of Artificial Sequence: Synthetic primer
gtctgggctggcctgatg

SEQ ID NO: 351 - DNA, 21 bp, Artificial Sequence
  Description of Artificial Sequence: Synthetic primer
gcccaggacggtaagatatcg

SEQ ID NO: 352 - DNA, 20 bp, Artificial Sequence
  Description of Artificial Sequence: Synthetic primer
gcgtgactcctggtacgatc

SEQ ID NO: 353 - DNA, 19 bp, Artificial Sequence
  Description of Artificial Sequence: Synthetic primer
ccctggcaagtcgaaaagc

SEQ ID NO: 354 - DNA, 20 bp, Artificial Sequence
  Description of Artificial Sequence: Synthetic primer
gcgtgactcctggtacgatt

SEQ ID NO: 355 - DNA, 26 bp, Artificial Sequence
  Description of Artificial Sequence: Synthetic primer
tcaggaaatcaatgtgcagaatcaac

SEQ ID NO: 356 - DNA, 30 bp, Artificial Sequence
  Description of Artificial Sequence: Synthetic primer
tttcgtttcacagttctatcatttacgtaa

SEQ ID NO: 357 - DNA, 26 bp, Artificial Sequence
  Description of Artificial Sequence: Synthetic primer
tcaggaaatcaatgtgcagaatcaat

SEQ ID NO: 358 - DNA, 19 bp, Artificial Sequence
  Description of Artificial Sequence: Synthetic primer
cgcatcagaaaacggcaga

SEQ ID NO: 359 - DNA, 22 bp, Artificial Sequence
  Description of Artificial Sequence: Synthetic primer
cgggtgactggatctatgtgac

SEQ ID NO: 360 - DNA, 19 bp, Artificial Sequence
  Description of Artificial Sequence: Synthetic primer
cgcatcagaaaacggcagc

SEQ ID NO: 361 - DNA, 26 bp, Artificial Sequence
  Description of Artificial Sequence: Synthetic primer
ataatttcttgcggatgatgacgaag

SEQ ID NO: 362 - DNA, 26 bp, Artificial Sequence
  Description of Artificial Sequence: Synthetic primer
cattattcatgtggcaaacggtatca

SEQ ID NO: 363 - DNA, 26 bp, Artificial Sequence
  Description of Artificial Sequence: Synthetic primer
ataatttcttgcggatgatgacgtaa

SEQ ID NO: 364 - DNA, 27 bp, Artificial Sequence
  Description of Artificial Sequence: Synthetic primer
tgtaatgtctcattctaccgatcactc

SEQ ID NO: 365 - DNA, 22 bp, Artificial Sequence
  Description of Artificial Sequence: Synthetic primer
agaacctgtaccactgccattg

SEQ ID NO: 366 - DNA, 27 bp, Artificial Sequence
  Description of Artificial Sequence: Synthetic primer
tgtaatgagtcattctaccgatcacag

SEQ ID NO: 367 - DNA, 28 bp, Artificial Sequence
  Description of Artificial Sequence: Synthetic primer
catgttgtccatcagttctttgtttttt

SEQ ID NO: 368 - DNA, 19 bp, Artificial Sequence
  Description of Artificial Sequence: Synthetic primer
gaccgcgtaaccatcgact

SEQ ID NO: 369 - DNA, 28 bp, Artificial Sequence
  Description of Artificial Sequence: Synthetic primer
catgttgtccatcagttctttgtttttg

SEQ ID NO: 370 - DNA, 23 bp, Artificial Sequence
  Description of Artificial Sequence: Synthetic primer
gtcccttgattttgttgacacgt

SEQ ID NO: 371 - DNA, 24 bp, Artificial Sequence
  Description of Artificial Sequence: Synthetic primer
aagctgaacaaaaaaatcccacca

SEQ ID NO: 372 - DNA, 23 bp, Artificial Sequence
  Description of Artificial Sequence: Synthetic primer
gtcccttgattttgttgacacgg

SEQ ID NO: 373 - DNA, 23 bp, Artificial Sequence
  Description of Artificial Sequence: Synthetic primer
agcattagaagtcgctggtgaag

SEQ ID NO: 374 - DNA, 22 bp, Artificial Sequence
  Description of Artificial Sequence: Synthetic primer
gtttttgctcagaacgccatgt

SEQ ID NO: 375 - DNA, 23 bp, Artificial Sequence
  Description of Artificial Sequence: Synthetic primer
agcatcaataatcgctggtgtaa

SEQ ID NO: 376 - DNA, 21 bp, Artificial Sequence
  Description of Artificial Sequence: Synthetic primer
tcattagtgacgcgggaaatg

SEQ ID NO: 377 - DNA, 22 bp, Artificial Sequence
  Description of Artificial Sequence: Synthetic primer
gatgcatgaaaatcgcgaggag

SEQ ID NO: 378 - DNA, 21 bp, Artificial Sequence
  Description of Artificial Sequence: Synthetic primer
tcattagtgacgcgggaaatc

SEQ ID NO: 379 - DNA, 22 bp, Artificial Sequence
  Description of Artificial Sequence: Synthetic primer
cctgagcaatttcatcggatga

SEQ ID NO: 380 - DNA, 29 bp, Artificial Sequence
  Description of Artificial Sequence: Synthetic primer
cgggtatcttactcatatcgctatattca

SEQ ID NO: 381 - DNA, 22 bp, Artificial Sequence
  Description of Artificial Sequence: Synthetic primer
cctgagcaatttcatcgctgct

SEQ ID NO: 382 - DNA, 24 bp, Artificial Sequence
  Description of Artificial Sequence: Synthetic primer
cagacacaggaacacgacaattag

SEQ ID NO: 383 - DNA, 19 bp, Artificial Sequence
  Description of Artificial Sequence: Synthetic primer
ggcgttctcctcttctcgt

SEQ ID NO: 384 - DNA, 24 bp, Artificial Sequence
  Description of Artificial Sequence: Synthetic primer
cagacacaggaacacgacaatcaa

SEQ ID NO: 385 - DNA, 24 bp, Artificial Sequence
  Description of Artificial Sequence: Synthetic primer
atacagacgcagctcatgatctag

SEQ ID NO: 386 - DNA, 22 bp, Artificial Sequence
  Description of Artificial Sequence: Synthetic primer
gtttgttaccgagcgtctgatc

SEQ ID NO: 387 - DNA, 24 bp, Artificial Sequence
  Description of Artificial Sequence: Synthetic primer
atacagacgcagctcatgatccaa

SEQ ID NO: 388 - DNA, 18 bp, Artificial Sequence
  Description of Artificial Sequence: Synthetic primer
tccgcgatgtcacctcac

SEQ ID NO: 389 - DNA, 18 bp, Artificial Sequence
  Description of Artificial Sequence: Synthetic primer
caacgcccagacccagag

SEQ ID NO: 390 - DNA, 18 bp, Artificial Sequence
  Description of Artificial Sequence: Synthetic primer
tccgcgatgtcaccagct

SEQ ID NO: 391 - DNA, 29 bp, Artificial Sequence
  Description of Artificial Sequence: Synthetic primer
gataagacacacggttagcatatttacaa

SEQ ID NO: 392 - DNA, 20 bp, Artificial Sequence
  Description of Artificial Sequence: Synthetic primer
gctatctcaccaggccacat

SEQ ID NO: 393 - DNA, 29 bp, Artificial Sequence
  Description of Artificial Sequence: Synthetic primer
gatagctcacacggttagcatatttacac

SEQ ID NO: 394 - DNA, 27 bp, Artificial Sequence
  Description of Artificial Sequence: Synthetic primer
tatgaatatctggaaccgctcgatcta

SEQ ID NO: 395 - DNA, 26 bp, Artificial Sequence
  Description of Artificial Sequence: Synthetic primer
gaaggaataagtacatcattgcggat

SEQ ID NO: 396 - DNA, 27 bp, Artificial Sequence
  Description of Artificial Sequence: Synthetic primer
tatgaatatctggaaccgctcgatttg

SEQ ID NO: 397 - DNA, 22 bp, Artificial Sequence
  Description of Artificial Sequence: Synthetic primer
ccagacaccggcaataatcaga

SEQ ID NO: 398 - DNA, 26 bp, Artificial Sequence
  Description of Artificial Sequence: Synthetic primer
catgatgaacacggaaggtaataacg

SEQ ID NO: 399 - DNA, 22 bp, Artificial Sequence
  Description of Artificial Sequence: Synthetic primer
ccagacaccggcaataatcagc

SEQ ID NO: 400 - DNA, 28 bp, Artificial Sequence
  Description of Artificial Sequence: Synthetic primer
cgcattaaagcagataaaaagcaccata

SEQ ID NO: 401 - DNA, 22 bp, Artificial Sequence
  Description of Artificial Sequence: Synthetic primer
atgaaataacctcagcgctgga

SEQ ID NO: 402 - DNA, 28 bp, Artificial Sequence
  Description of Artificial Sequence: Synthetic primer
cgcattaaagcagataaataacaccatc

SEQ ID NO: 403 - DNA, 21 bp, Artificial Sequence
  Description of Artificial Sequence: Synthetic primer
tgtttttccgtacgactcgct

SEQ ID NO: 404 - DNA, 18 bp, Artificial Sequence
  Description of Artificial Sequence: Synthetic primer
cgcctcagttcccgtgac

SEQ ID NO: 405 - DNA, 21 bp, Artificial Sequence
  Description of Artificial Sequence: Synthetic primer
tgtttttccgtacgactcgca

SEQ ID NO: 406 - DNA, 27 bp, Artificial Sequence
  Description of Artificial Sequence: Synthetic primer
cgtttctctgctaatctttcgatgctt

SEQ ID NO: 407 - DNA, 19 bp, Artificial Sequence
  Description of Artificial Sequence: Synthetic primer
ctgctacgccatcccgaaa

SEQ ID NO: 408 - DNA, 27 bp, Artificial Sequence
  Description of Artificial Sequence: Synthetic primer
cgtttctctgctaatttatcgatgtta

SEQ ID NO: 409 - DNA, 23 bp, Artificial Sequence
  Description of Artificial Sequence: Synthetic primer
tgtgtttcgatataaccgtggga

SEQ ID NO: 410 - DNA, 23 bp, Artificial Sequence
  Description of Artificial Sequence: Synthetic primer
ggccgaagactcacaaatctttc

SEQ ID NO: 411 - DNA, 23 bp, Artificial Sequence
  Description of Artificial Sequence: Synthetic primer
tgtgtttcgatataaccgtggct

SEQ ID NO: 412 - DNA, 21 bp, Artificial Sequence
  Description of Artificial Sequence: Synthetic primer
ctctcagcagacgagaaatca

SEQ ID NO: 413 - DNA, 21 bp, Artificial Sequence
  Description of Artificial Sequence: Synthetic primer
aggcaaaccagacattctcgt

SEQ ID NO: 414 - DNA, 21 bp, Artificial Sequence
  Description of Artificial Sequence: Synthetic primer
ctcagtgcagacgagaaaagc

SEQ ID NO: 415 - DNA, 22 bp, Artificial Sequence
  Description of Artificial Sequence: Synthetic primer
gccaagtacagcggaaagtttt

SEQ ID NO: 416 - DNA, 20 bp, Artificial Sequence
  Description of Artificial Sequence: Synthetic primer
caacttatggcgtgctgtcg

SEQ ID NO: 417 - DNA, 22 bp, Artificial Sequence
  Description of Artificial Sequence: Synthetic primer
gcccaatacagcggaaagttta

SEQ ID NO: 418 - DNA, 31 bp, Artificial Sequence
  Description of Artificial Sequence: Synthetic primer
tgtaatgatgaatgacttttcttttacacca

SEQ ID NO: 419 - DNA, 25 bp, Artificial Sequence
  Description of Artificial Sequence: Synthetic primer
aatacatccgcaattctcaaacctg

SEQ ID NO: 420 - DNA, 31 bp, Artificial Sequence
  Description of Artificial Sequence: Synthetic primer
tgtaatgatgaatgacttttcttttacaccg

SEQ ID NO: 421 - DNA, 20 bp, Artificial Sequence
  Description of Artificial Sequence: Synthetic primer
gtcagtttatccacgcctga

SEQ ID NO: 422 - DNA, 22 bp, Artificial Sequence
  Description of Artificial Sequence: Synthetic primer
acgtctacaaggcttcgatacc

SEQ ID NO: 423 - DNA, 20 bp, Artificial Sequence
  Description of Artificial Sequence: Synthetic primer
gtcagtttatccacgccgct

SEQ ID NO: 424 - DNA, 23 bp, Artificial Sequence
  Description of Artificial Sequence: Synthetic primer
tgatgctgaaccgcattgtaaag

SEQ ID NO: 425 - DNA, 24 bp, Artificial Sequence
  Description of Artificial Sequence: Synthetic primer
tgaagaacaactcgatacagcact

SEQ ID NO: 426 - DNA, 23 bp, Artificial Sequence
  Description of Artificial Sequence: Synthetic primer
tgatgctgaaccgcattgtacaa

SEQ ID NO: 427 - DNA, 23 bp, Artificial Sequence
  Description of Artificial Sequence: Synthetic primer
gaaggtgaaaaggtggtttcctc

SEQ ID NO: 428 - DNA, 23 bp, Artificial Sequence
  Description of Artificial Sequence: Synthetic primer
ggttagcggataagtcacctgat

SEQ ID NO: 429 - DNA, 23 bp, Artificial Sequence
  Description of Artificial Sequence: Synthetic primer
gaaggtgaaaaggtggtttccag

SEQ ID NO: 430 - DNA, 25 bp, Artificial Sequence
  Description of Artificial Sequence: Synthetic primer
cacctgatttaccgcttttggaatt

SEQ ID NO: 431 - DNA, 24 bp, Artificial Sequence
  Description of Artificial Sequence: Synthetic primer
cgagttctggtttgcgcttattaa

SEQ ID NO: 432 - DNA, 25 bp, Artificial Sequence
  Description of Artificial Sequence: Synthetic primer
cacctgatttaccgcttttggaatg

SEQ ID NO: 433 - DNA, 20 bp, Artificial Sequence
  Description of Artificial Sequence: Synthetic primer
cgaccattacccctttcgga

SEQ ID NO: 434 - DNA, 23 bp, Artificial Sequence
  Description of Artificial Sequence: Synthetic primer
tgaaaatgatgctggaagatgcg

SEQ ID NO: 435 - DNA, 20 bp, Artificial Sequence
  Description of Artificial Sequence: Synthetic primer
cgaccattacccctttcggc

SEQ ID NO: 436 - DNA, 30 bp, Artificial Sequence
  Description of Artificial Sequence: Synthetic primer
atagaagctccagtagatcaatctgatgag

SEQ ID NO: 437 - DNA, 22 bp, Artificial Sequence
  Description of Artificial Sequence: Synthetic primer
cacgggaataactcatctggca

SEQ ID NO: 438 - DNA, 30 bp, Artificial Sequence
  Description of Artificial Sequence: Synthetic primer
ttaacaactccagcaaatcaatctgatgac

SEQ ID NO: 439 - DNA, 22 bp, Artificial Sequence
  Description of Artificial Sequence: Synthetic primer
ggctcataactacgccatgtca

SEQ ID NO: 440 - DNA, 20 bp, Artificial Sequence
  Description of Artificial Sequence: Synthetic primer
gcccatcagctcatcttcca

SEQ ID NO: 441 - DNA, 22 bp, Artificial Sequence
  Description of Artificial Sequence: Synthetic primer
ggctcataactacgccatgagt

SEQ ID NO: 442 - DNA, 23 bp, Artificial Sequence
  Description of Artificial Sequence: Synthetic primer
gcgtgtattttgccatgaactca

SEQ ID NO: 443 - DNA, 21 bp, Artificial Sequence
  Description of Artificial Sequence: Synthetic primer
tgcggtcagggtacaaatcag

SEQ ID NO: 444 - DNA, 23 bp, Artificial Sequence
  Description of Artificial Sequence: Synthetic primer
gcgtgtattttgccatgaacagc

SEQ ID NO: 445 - DNA, 29 bp, Artificial Sequence
  Description of Artificial Sequence: Synthetic primer
catatttgattttagcgatggtttcagat

SEQ ID NO: 446 - DNA, 18 bp, Artificial Sequence
  Description of Artificial Sequence: Synthetic primer
gcaacacctcagcctgca

SEQ ID NO: 447 - DNA, 29 bp, Artificial Sequence
  Description of Artificial Sequence: Synthetic primer
catatttgattttagcgatggtttcagag

SEQ ID NO: 448 - DNA, 23 bp, Artificial Sequence
  Description of Artificial Sequence: Synthetic primer
caataattgactgtgccggatct

SEQ ID NO: 449 - DNA, 22 bp, Artificial Sequence
  Description of Artificial Sequence: Synthetic primer
cgctgcgctcaataaaaaacag

SEQ ID NO: 450 - DNA, 23 bp, Artificial Sequence
  Description of Artificial Sequence: Synthetic primer
caataattgactgtgccggatcg

SEQ ID NO: 451 - DNA, 20 bp, Artificial Sequence
  Description of Artificial Sequence: Synthetic primer
cctcgaagactccgtagcac

SEQ ID NO: 452 - DNA, 19 bp, Artificial Sequence
  Description of Artificial Sequence: Synthetic primer
atttccactgcgcgggtaa

SEQ ID NO: 453 - DNA, 20 bp, Artificial Sequence
  Description of Artificial Sequence: Synthetic primer
cctcgaagactccgtagcat

SEQ ID NO: 454 - DNA, 23 bp, Artificial Sequence
  Description of Artificial Sequence: Synthetic primer
tgacagctccacttaccctacta

SEQ ID NO: 455 - DNA, 22 bp, Artificial Sequence
  Description of Artificial Sequence: Synthetic primer
cagacaccgtttccatatccga

SEQ ID NO: 456 - DNA, 23 bp, Artificial Sequence
  Description of Artificial Sequence: Synthetic primer
tgacagctccattaaccctattg

SEQ ID NO: 457 - DNA, 25 bp, Artificial Sequence
  Description of Artificial Sequence: Synthetic primer
gctccacgactactggaaaatattc

SEQ ID NO: 458 - DNA, 28 bp, Artificial Sequence
  Description of Artificial Sequence: Synthetic primer
tcaataggttaatcaatggggtgagtta

SEQ ID NO: 459 - DNA, 25 bp, Artificial Sequence
  Description of Artificial Sequence: Synthetic primer
gctccacgtttactggaaaatattt

SEQ ID NO: 460 - DNA, 31 bp, Artificial Sequence
  Description of Artificial Sequence: Synthetic primer
cgaagacataaacgaaaagtatcagcataag

SEQ ID NO: 461 - DNA, 25 bp, Artificial Sequence
  Description of Artificial Sequence: Synthetic primer
tactgactttatcttcgcggtactg

SEQ ID NO: 462 - DNA, 31 bp, Artificial Sequence
  Description of Artificial Sequence: Synthetic primer
cgaagacataaacgaataatatcagcattaa

SEQ ID NO: 463 - DNA, 23 bp, Artificial Sequence
  Description of Artificial Sequence: Synthetic primer
cgtaacgttcaaccatgacttgt

SEQ ID NO: 464 - DNA, 20 bp, Artificial Sequence
  Description of Artificial Sequence: Synthetic primer
gccatcgccgataaactgac

SEQ ID NO: 465 - DNA, 23 bp, Artificial Sequence
  Description of Artificial Sequence: Synthetic primer
cgtaacgttcaaccatcacctgc

SEQ ID NO: 466 - DNA, 23 bp, Artificial Sequence
  Description of Artificial Sequence: Synthetic primer
gggtagggtaatacgcatcatcc

SEQ ID NO: 467 - DNA, 21 bp, Artificial Sequence
  Description of Artificial Sequence: Synthetic primer
tttgcactttccactccgatg

SEQ ID NO: 468 - DNA, 23 bp, Artificial Sequence
  Description of Artificial Sequence: Synthetic primer
aggtagggtaatacgcatcatca

SEQ ID NO: 469 - DNA, 23 bp, Artificial Sequence
  Description of Artificial Sequence: Synthetic primer
cataacctatcaccagcaccgta

SEQ ID NO: 470 - DNA, 24 bp, Artificial Sequence
  Description of Artificial Sequence: Synthetic primer
tatttcgcgctactagtgatggtt

SEQ ID NO: 471 - DNA, 23 bp, Artificial Sequence
  Description of Artificial Sequence: Synthetic primer
cataacctatcaccagcaccgtt

SEQ ID NO: 472 - DNA, 23 bp, Artificial Sequence
  Description of Artificial Sequence: Synthetic primer
ctttaagcgggccatcaatctga

SEQ ID NO: 473 - DNA, 20 bp, Artificial Sequence
  Description of Artificial Sequence: Synthetic primer
gctggccttctctccttacg

SEQ ID NO: 474 - DNA, 23 bp, Artificial Sequence
  Description of Artificial Sequence: Synthetic primer
cttttaacgggccatcaatctgg

SEQ ID NO: 475 - DNA, 29 bp, Artificial Sequence
  Description of Artificial Sequence: Synthetic primer
ataatcaggtctggattcttctctttgag

SEQ ID NO: 476 - DNA, 24 bp, Artificial Sequence
  Description of Artificial Sequence: Synthetic primer
gataacgctcatactggtcacaac

SEQ ID NO: 477 - DNA, 29 bp, Artificial Sequence
  Description of Artificial Sequence: Synthetic primer
ataatcaggtctggattcttctcttttaa

SEQ ID NO: 478 - DNA, 22 bp, Artificial Sequence
  Description of Artificial Sequence: Synthetic primer
gactggtccggtatttatgcct

SEQ ID NO: 479 - DNA, 21 bp, Artificial Sequence
  Description of Artificial Sequence: Synthetic primer
ccctgtaggtcgtcgagaaat

SEQ ID NO: 480 - DNA, 22 bp, Artificial Sequence
  Description of Artificial Sequence: Synthetic primer
gactggtccggtatttatgcca

SEQ ID NO: 481 - DNA, 22 bp, Artificial Sequence
  Description of Artificial Sequence: Synthetic primer
gcgatcaatccaaatctcacct

SEQ ID NO: 482 - DNA, 19 bp, Artificial Sequence
  Description of Artificial Sequence: Synthetic primer
tgaccaagcaggacaacac

SEQ ID NO: 483 - DNA, 22 bp, Artificial Sequence
  Description of Artificial Sequence: Synthetic primer
gcgatcaatccaaatctcaccg

SEQ ID NO: 484 - DNA, 24 bp, Artificial Sequence
  Description of Artificial Sequence: Synthetic primer
cgtttgtatagatcttccgccgat

SEQ ID NO: 485 - DNA, 29 bp, Artificial Sequence
  Description of Artificial Sequence: Synthetic primer
gagcaaattctgtcacttcttctaatgaa

SEQ ID NO: 486 - DNA, 24 bp, Artificial Sequence
  Description of Artificial Sequence: Synthetic primer
cgtttgtataaatcttccgcactg

SEQ ID NO: 487 - DNA, 21 bp, Artificial Sequence
  Description of Artificial Sequence: Synthetic primer
gcttcttgcggattcatcgat

SEQ ID NO: 488 - DNA, 21 bp, Artificial Sequence
  Description of Artificial Sequence: Synthetic primer
ctccacctcaccgttctatcc

SEQ ID NO: 489 - DNA, 21 bp, Artificial Sequence
  Description of Artificial Sequence: Synthetic primer
gcttcttgcggattcatgctg

SEQ ID NO: 490 - DNA, 23 bp, Artificial Sequence
  Description of Artificial Sequence: Synthetic primer
aaaaaaacgtcgggcaattctct

SEQ ID NO: 491 - DNA, 19 bp, Artificial Sequence
  Description of Artificial Sequence: Synthetic primer
gctacccgcgcctgataac

SEQ ID NO: 492 - DNA, 23 bp, Artificial Sequence
  Description of Artificial Sequence: Synthetic primer
aaaaaaacgtcgggcaattctca

SEQ ID NO: 493 - DNA, 25 bp, Artificial Sequence
  Description of Artificial Sequence: Synthetic primer
ggtgtgtgaaggatttgatgactct

SEQ ID NO: 494 - DNA, 23 bp, Artificial Sequence
  Description of Artificial Sequence: Synthetic primer
tgtttacaaagcgaggggtgata

SEQ ID NO: 495 - DNA, 25 bp, Artificial Sequence
  Description of Artificial Sequence: Synthetic primer
ggtgtgtgaaggatttgatgacagc

SEQ ID NO: 496 - DNA, 23 bp, Artificial Sequence
  Description of Artificial Sequence: Synthetic primer
tggaatacgtggtctggtttctt

SEQ ID NO: 497 - DNA, 19 bp, Artificial Sequence
  Description of Artificial Sequence: Synthetic primer
ggcgtcattacccaccagt

SEQ ID NO: 498 - DNA, 23 bp, Artificial Sequence
  Description of Artificial Sequence: Synthetic primer
tggaatacgtggtctggttttta

SEQ ID NO: 499 - DNA, 22 bp, Artificial Sequence
  Description of Artificial Sequence: Synthetic primer
ggcattcaggttagtagaggac

SEQ ID NO: 500 - DNA, 24 bp, Artificial Sequence
  Description of Artificial Sequence: Synthetic primer
ttaactggcaaaaaaagggtgaca

SEQ ID NO: 501 - DNA, 22 bp, Artificial Sequence
  Description of Artificial Sequence: Synthetic primer
ggcattcaggttagtgctgctg

SEQ ID NO: 502 - DNA, 22 bp, Artificial Sequence
  Description of Artificial Sequence: Synthetic primer
gcaggagtcctcgtatggtatc

SEQ ID NO: 503 - DNA, 22 bp, Artificial Sequence
  Description of Artificial Sequence: Synthetic primer
cgtagtcggttagaacttgcca

SEQ ID NO: 504 - DNA, 22 bp, Artificial Sequence
  Description of Artificial Sequence: Synthetic primer
gcaggagtcctcgtatggtaag

SEQ ID NO: 505 - DNA, 19 bp, Artificial Sequence
  Description of Artificial Sequence: Synthetic primer
tgccgttgttgaccgttca

SEQ ID NO: 506 - DNA, 24 bp, Artificial Sequence
  Description of Artificial Sequence: Synthetic primer
ccatgaagattttggtgaactgct

SEQ ID NO: 507 - DNA, 19 bp, Artificial Sequence
  Description of Artificial Sequence: Synthetic primer
tgccgttgttgaccgtagt

SEQ ID NO: 508 - DNA, 28 bp, Artificial Sequence
  Description of Artificial Sequence: Synthetic primer
gaatccattgaattttgatgaaagacgt

SEQ ID NO: 509 - DNA, 22 bp, Artificial Sequence
  Description of Artificial Sequence: Synthetic primer
gcctataccgcctattctctgg

SEQ ID NO: 510 - DNA, 28 bp, Artificial Sequence
  Description of Artificial Sequence: Synthetic primer
gaatccattgaatttactgctaagacgc

SEQ ID NO: 511 - DNA, 27 bp, Artificial Sequence
  Description of Artificial Sequence: Synthetic primer
ctgatgtctaagattatcgcgactcta

SEQ ID NO: 512 - DNA, 22 bp, Artificial Sequence
  Description of Artificial Sequence: Synthetic primer
ttgcgtgaaaacaagagaggtg

SEQ ID NO: 513 - DNA, 27 bp, Artificial Sequence
  Description of Artificial Sequence: Synthetic primer
ctgatgagtaagattatcgcgactttg

SEQ ID NO: 514 - DNA, 28 bp, Artificial Sequence
  Description of Artificial Sequence: Synthetic primer
cagacggtaaatttatggtaatggtttc

SEQ ID NO: 515 - DNA, 25 bp, Artificial Sequence
  Description of Artificial Sequence: Synthetic primer
gtgactttgtaagacgggttagaac

SEQ ID NO: 516 - DNA, 28 bp, Artificial Sequence
  Description of Artificial Sequence: Synthetic primer
gcgacggtaaatttatggtaatggtcag

SEQ ID NO: 517 - DNA, 28 bp, Artificial Sequence
  Description of Artificial Sequence: Synthetic primer
gtcgaacttattgatcatcttgattccc

SEQ ID NO: 518 - DNA, 18 bp, Artificial Sequence
  Description of Artificial Sequence: Synthetic primer
gctctcgcagtcgttcat

SEQ ID NO: 519 - DNA, 28 bp, Artificial Sequence
  Description of Artificial Sequence: Synthetic primer
gtcgaacttattgatcatcttgatagtt

SEQ ID NO: 520 - DNA, 31 bp, Artificial Sequence
  Description of Artificial Sequence: Synthetic primer
catctgggatatcaaaaagcatatcggttat

SEQ ID NO: 521 - DNA, 23 bp, Artificial Sequence
  Description of Artificial Sequence: Synthetic primer
caagacgatgggtaatacaggca

SEQ ID NO: 522 - DNA, 31 bp, Artificial Sequence
  Description of Artificial Sequence: Synthetic primer
catctgggatatcaaaaagcatatcggttac

SEQ ID NO: 523 - DNA, 23 bp, Artificial Sequence
  Description of Artificial Sequence: Synthetic primer
taccaatggctcgtaaatggcta

SEQ ID NO: 524 - DNA, 18 bp, Artificial Sequence
  Description of Artificial Sequence: Synthetic primer
tgccgagcagtgtctgac

SEQ ID NO: 525 - DNA, 23 bp, Artificial Sequence
  Description of Artificial Sequence: Synthetic primer
taccaatggctcgtaaatggttg

SEQ ID NO: 526 - DNA, 30 bp, Artificial Sequence
  Description of Artificial Sequence: Synthetic primer
aaatgttcttcggcaattatttcgttattc

SEQ ID NO: 527 - DNA, 26 bp, Artificial Sequence
  Description of Artificial Sequence: Synthetic primer
tggaacatgctgtaaatattctcgtc

SEQ ID NO: 528 - DNA, 30 bp, Artificial Sequence
  Description of Artificial Sequence: Synthetic primer
aaatgttcttcggcaattatttcgttatta

SEQ ID NO: 529 - DNA, 19 bp, Artificial Sequence
  Description of Artificial Sequence: Synthetic primer
tcgcagtaatcgaggctga

SEQ ID NO: 530 - DNA, 21 bp, Artificial Sequence
  Description of Artificial Sequence: Synthetic primer
ggtttggctctggtctggtag

SEQ ID NO: 531 - DNA, 19 bp, Artificial Sequence
  Description of Artificial Sequence: Synthetic primer
tcgcagtaatcgaggcgct

SEQ ID NO: 532 - DNA, 20 bp, Artificial Sequence
  Description of Artificial Sequence: Synthetic primer
agagatcgagggccgttact

SEQ ID NO: 533 - DNA, 18 bp, Artificial Sequence
  Description of Artificial Sequence: Synthetic primer
cagccgcacactatgagc

SEQ ID NO: 534 - DNA, 20 bp, Artificial Sequence
  Description of Artificial Sequence: Synthetic primer
agagatctaaggccgtcacc

SEQ ID NO: 535 - DNA, 22 bp, Artificial Sequence
  Description of Artificial Sequence: Synthetic primer
cggtgtcgaaatggaagcactc

SEQ ID NO: 536 - DNA, 18 bp, Artificial Sequence
  Description of Artificial Sequence: Synthetic primer
cgatgcgcagaggtgaca

SEQ ID NO: 537 - DNA, 22 bp, Artificial Sequence
  Description of Artificial Sequence: Synthetic primer
cggtgtcgaaatggaagcatta

SEQ ID NO: 538 - DNA, 22 bp, Artificial Sequence
  Description of Artificial Sequence: Synthetic primer
tgtttagcctctggaccgtaag

SEQ ID NO: 539 - DNA, 23 bp, Artificial Sequence
  Description of Artificial Sequence: Synthetic primer
cggactggatgagatttttaccc

SEQ ID NO: 540 - DNA, 22 bp, Artificial Sequence
  Description of Artificial Sequence: Synthetic primer
tgtttagcctctggaccgtagc

SEQ ID NO: 541 - DNA, 22 bp, Artificial Sequence
  Description of Artificial Sequence: Synthetic primer
cgaaaacgtccgtgattactca

SEQ ID NO: 542 - DNA, 25 bp, Artificial Sequence
  Description of Artificial Sequence: Synthetic primer
gatgccatctttattgagctgttca

SEQ ID NO: 543 - DNA, 22 bp, Artificial Sequence
  Description of Artificial Sequence: Synthetic primer
cgaaaacgtccgtgattacagc

SEQ ID NO: 544 - DNA, 19 bp, Artificial Sequence
  Description of Artificial Sequence: Synthetic primer
caacctgacgccgctactt

SEQ ID NO: 545 - DNA, 27 bp, Artificial Sequence
  Description of Artificial Sequence: Synthetic primer
gattagcatacacttcaccttcagtac

SEQ ID NO: 546 - DNA, 19 bp, Artificial Sequence
  Description of Artificial Sequence: Synthetic primer
caacctgacgccgttgttg

SEQ ID NO: 547 - DNA, 23 bp, Artificial Sequence
  Description of Artificial Sequence: Synthetic primer
ccgtctgaacctttatgcatgga

SEQ ID NO: 548 - DNA, 25 bp, Artificial Sequence
  Description of Artificial Sequence: Synthetic primer
ctgttccgcactgatatcgaaaatg

SEQ ID NO: 549 - DNA, 23 bp, Artificial Sequence
  Description of Artificial Sequence: Synthetic primer
ccgtctgaacctttatgcatact

SEQ ID NO: 550 - DNA, 19 bp, Artificial Sequence
  Description of Artificial Sequence: Synthetic primer
ccatcacaagcaggccaga

SEQ ID NO: 551 - DNA, 23 bp, Artificial Sequence
  Description of Artificial Sequence: Synthetic primer
cgcggataaaaaacttgttgtcg

SEQ ID NO: 552 - DNA, 19 bp, Artificial Sequence
  Description of Artificial Sequence: Synthetic primer
ccatcactaacaggccgct

SEQ ID NO: 553 - DNA, 26 bp, Artificial Sequence
  Description of Artificial Sequence: Synthetic primer
cagcaaatataagaccgttaactgat

SEQ ID NO: 554 - DNA, 24 bp, Artificial Sequence
  Description of Artificial Sequence: Synthetic primer
cgttttgctaaggatgtcatcgtc

SEQ ID NO: 555 - DNA, 26 bp, Artificial Sequence
  Description of Artificial Sequence: Synthetic primer
cagcaaatatcaaaccgttaacgctg

SEQ ID NO: 556 - DNA, 21 bp, Artificial Sequence
  Description of Artificial Sequence: Synthetic primer
cgaactgcatggtgacgttag

SEQ ID NO: 557 - DNA, 24 bp, Artificial Sequence
  Description of Artificial Sequence: Synthetic primer
attccagctcacagtgaaatcaga

SEQ ID NO: 558 - DNA, 21 bp, Artificial Sequence
  Description of Artificial Sequence: Synthetic primer
cgaactgcatggtgacgttac

SEQ ID NO: 559 - DNA, 20 bp, Artificial Sequence
  Description of Artificial Sequence: Synthetic primer
cggtcacagtctgaatgcct

SEQ ID NO: 560 - DNA, 21 bp, Artificial Sequence
  Description of Artificial Sequence: Synthetic primer
gtgcgtcatacagcagatcct

SEQ ID NO: 561 - DNA, 20 bp, Artificial Sequence
  Description of Artificial Sequence: Synthetic primer
cggtcacagtctgaatgccg

SEQ ID NO: 562 - DNA, 22 bp, Artificial Sequence
  Description of Artificial Sequence: Synthetic primer
ggtccgcaatctctctttttca

SEQ ID NO: 563 - DNA, 18 bp, Artificial Sequence
  Description of Artificial Sequence: Synthetic primer
ctgccaccacgcccatat

SEQ ID NO: 564 - DNA, 22 bp, Artificial Sequence
  Description of Artificial Sequence: Synthetic primer
ggtccgcaatctctcttttagt

SEQ ID NO: 565 - DNA, 24 bp, Artificial Sequence
  Description of Artificial Sequence: Synthetic primer
gcaataatcacgttagcaatgcct

SEQ ID NO: 566 - DNA, 29 bp, Artificial Sequence
  Description of Artificial Sequence: Synthetic primer
gtacaagtaaggatgcgactatttaactg

SEQ ID NO: 567 - DNA, 24 bp, Artificial Sequence
  Description of Artificial Sequence: Synthetic primer
gcaataatcacgttagcaatgccg

SEQ ID NO: 568 - DNA, 20 bp, Artificial Sequence
  Description of Artificial Sequence: Synthetic primer
tccggtggtgtacggacaag

SEQ ID NO: 569 - DNA, 23 bp, Artificial Sequence
  Description of Artificial Sequence: Synthetic primer
actttacttcaccatcggagtcc

SEQ ID NO: 570 - DNA, 20 bp, Artificial Sequence
  Description of Artificial Sequence: Synthetic primer
tccggtggtgttctgactaa

SEQ ID NO: 571 - DNA, 22 bp, Artificial Sequence
  Description of Artificial Sequence: Synthetic primer
ctgggaggggatgtttgttcta

SEQ ID NO: 572 - DNA, 19 bp, Artificial Sequence
  Description of Artificial Sequence: Synthetic primer
cgcaagcagaaggttaccc

SEQ ID NO: 573 - DNA, 22 bp, Artificial Sequence
  Description of Artificial Sequence: Synthetic primer
ctgggaggggatgtttgttttg

SEQ ID NO: 574 - DNA, 19 bp, Artificial Sequence
  Description of Artificial Sequence: Synthetic primer
gttcgagatgctggggtca

SEQ ID NO: 575 - DNA, 20 bp, Artificial Sequence
  Description of Artificial Sequence: Synthetic primer
cggaaagcgtcaatcactga

SEQ ID NO: 576 - DNA, 19 bp, Artificial Sequence
  Description of Artificial Sequence: Synthetic primer
gttcgagatgctggggagc

SEQ ID NO: 577 - DNA, 30 bp, Artificial Sequence
  Description of Artificial Sequence: Synthetic primer
ctgccatttctgattgtctttaaaatatca

SEQ ID NO: 578 - DNA, 23 bp, Artificial Sequence
  Description of Artificial Sequence: Synthetic primer
gccgatcagtagacagcaaaatg

SEQ ID NO: 579 - DNA, 30 bp, Artificial Sequence
  Description of Artificial Sequence: Synthetic primer
ctgccatttctgattgtctttaaaataagc

SEQ ID NO: 580 - DNA, 18 bp, Artificial Sequence
  Description of Artificial Sequence: Synthetic primer
cagggacgggatcagtga

SEQ ID NO: 581 - DNA, 23 bp, Artificial Sequence
  Description of Artificial Sequence: Synthetic primer
tctgccgcagagaaaatcaattt

SEQ ID NO: 582 - DNA, 18 bp, Artificial Sequence
  Description of Artificial Sequence: Synthetic primer
cagggacgggatcaggct

SEQ ID NO: 583 - DNA, 25 bp, Artificial Sequence
  Description of Artificial Sequence: Synthetic primer
tgagagatcgactttatggcatgac

SEQ ID NO: 584 - DNA, 28 bp, Artificial Sequence
  Description of Artificial Sequence: Synthetic primer
aatacctgaaagaagcatgggaatttac

SEQ ID NO: 585 - DNA, 25 bp, Artificial Sequence
  Description of Artificial Sequence: Synthetic primer
gctgagatcgactttatggcaactg

SEQ ID NO: 586 - DNA, 22 bp, Artificial Sequence
  Description of Artificial Sequence: Synthetic primer
gacaaactccttacgctgaaag

SEQ ID NO: 587 - DNA, 24 bp, Artificial Sequence
  Description of Artificial Sequence: Synthetic primer
ggtgatgatttctctgcggttatc

SEQ ID NO: 588 - DNA, 22 bp, Artificial Sequence
  Description of Artificial Sequence: Synthetic primer
gacaaactccttacgcgctcaa

SEQ ID NO: 589 - DNA, 24 bp, Artificial Sequence
  Description of Artificial Sequence: Synthetic primer
agaattacctgaccaccgttcatt

SEQ ID NO: 590 - DNA, 21 bp, Artificial Sequence
  Description of Artificial Sequence: Synthetic primer
caaaccaggagctgcacaatg

SEQ ID NO: 591 - DNA, 24 bp, Artificial Sequence
  Description of Artificial Sequence: Synthetic primer
agaattacctgaccaccgttcatc

SEQ ID NO: 592 - DNA, 24 bp, Artificial Sequence
  Description of Artificial Sequence: Synthetic primer
tattgcacgcattccagagaagtc

SEQ ID NO: 593 - DNA, 20 bp, Artificial Sequence
  Description of Artificial Sequence: Synthetic primer
gggtgcgctttctcgatttc

SEQ ID NO: 594 - DNA, 24 bp, Artificial Sequence
  Description of Artificial Sequence: Synthetic primer
tattgcacgcattccagagaagag

SEQ ID NO: 595 - DNA, 22 bp, Artificial Sequence
  Description of Artificial Sequence: Synthetic primer
catctgcgcatttacaccttct

SEQ ID NO: 596 - DNA, 21 bp, Artificial Sequence
  Description of Artificial Sequence: Synthetic primer
gtccgcgaagatgagtcagat

SEQ ID NO: 597 - DNA, 22 bp, Artificial Sequence
  Description of Artificial Sequence: Synthetic primer
catctgcgcatttacaccttca

SEQ ID NO: 598 - DNA, 31 bp, Artificial Sequence
  Description of Artificial Sequence: Synthetic primer
atacagagagacaataataatggtagattct

SEQ ID NO: 599 - DNA, 21 bp, Artificial Sequence
  Description of Artificial Sequence: Synthetic primer
gcgccacgattcagagtaatc

SEQ ID NO: 600 - DNA, 31 bp, Artificial Sequence
  Description of Artificial Sequence: Synthetic primer
atacagagagacaataataatggtagatagc

SEQ ID NO: 601 - DNA, 21 bp, Artificial Sequence
  Description of Artificial Sequence: Synthetic primer
ccgatcgctgtcgtttttact

SEQ ID NO: 602 - DNA, 27 bp, Artificial Sequence
  Description of Artificial Sequence: Synthetic primer
ttcgagtgaaaatctacctatctcttt

SEQ ID NO: 603 - DNA, 21 bp, Artificial Sequence
  Description of Artificial Sequence: Synthetic primer
ccgatcgctgtcgtttttacc

SEQ ID NO: 604 - DNA, 19 bp, Artificial Sequence
  Description of Artificial Sequence: Synthetic primer
ctggcggatcgtgcttcta

SEQ ID NO: 605 - DNA, 19 bp, Artificial Sequence
  Description of Artificial Sequence: Synthetic primer
gccatccccacggtcatat

SEQ ID NO: 606 - DNA, 19 bp, Artificial Sequence
  Description of Artificial Sequence: Synthetic primer
ctggcggatcgtgcttttg

SEQ ID NO: 607 - DNA, 23 bp, Artificial Sequence
  Description of Artificial Sequence: Synthetic primer
tcgtaccctggttaccaaaaact

SEQ ID NO: 608 - DNA, 18 bp, Artificial Sequence
  Description of Artificial Sequence: Synthetic primer
ccaggtcaacagccaggt

SEQ ID NO: 609 - DNA, 23 bp, Artificial Sequence
  Description of Artificial Sequence: Synthetic primer
tcgtaccctggttaccaaaaaca

SEQ ID NO: 610 - DNA, 26 bp, Artificial Sequence
  Description of Artificial Sequence: Synthetic primer
ccgcaaaaaagtagttggttgatagt

SEQ ID NO: 611 - DNA, 24 bp, Artificial Sequence
  Description of Artificial Sequence: Synthetic primer
ccatcggcacatcatcataaaacg

SEQ ID NO: 612 - DNA, 26 bp, Artificial Sequence
  Description of Artificial Sequence: Synthetic primer
ccgcaaaaaagtagttggttgagaga

SEQ ID NO: 613 - DNA, 30 bp, Artificial Sequence
  Description of Artificial Sequence: Synthetic primer
cttaatgcctataaagcagcaacactatct

SEQ ID NO: 614 - DNA, 20 bp, Artificial Sequence
  Description of Artificial Sequence: Synthetic primer
tgggttgagatgccacgttt

SEQ ID NO: 615 - DNA, 30 bp, Artificial Sequence
  Description of Artificial Sequence: Synthetic primer
ttaaatgcctataaagcagcaacattaagc

SEQ ID NO: 616 - DNA, 24 bp, Artificial Sequence
  Description of Artificial Sequence: Synthetic primer
gctgaatcttatccgctgcttcta

SEQ ID NO: 617 - DNA, 21 bp, Artificial Sequence
  Description of Artificial Sequence: Synthetic primer
gttcaagctgagcaacgtcac

SEQ ID NO: 618 - DNA, 24 bp, Artificial Sequence
  Description of Artificial Sequence: Synthetic primer
gctgaatcttatccgctgttattg

SEQ ID NO: 619 - DNA, 23 bp, Artificial Sequence
  Description of Artificial Sequence: Synthetic primer
gtttcatagccaacacgatctga

SEQ ID NO: 620 - DNA, 21 bp, Artificial Sequence
  Description of Artificial Sequence: Synthetic primer
ggtgtctacagcggaagtagg

SEQ ID NO: 621 - DNA, 23 bp, Artificial Sequence
  Description of Artificial Sequence: Synthetic primer
gtttcatagccaacacgatcgct

SEQ ID NO: 622 - DNA, 25 bp, Artificial Sequence
  Description of Artificial Sequence: Synthetic primer
ctgacgaccacacatcatattaagt

SEQ ID NO: 623 - DNA, 20 bp, Artificial Sequence
  Description of Artificial Sequence: Synthetic primer
gccgccttttctttttccga

SEQ ID NO: 624 - DNA, 25 bp, Artificial Sequence
  Description of Artificial Sequence: Synthetic primer
ctgacgaccacacatcatattaagc

SEQ ID NO: 625 - DNA, 25 bp, Artificial Sequence
  Description of Artificial Sequence: Synthetic primer
cttgacttcgatgcactgattaact

SEQ ID NO: 626 - DNA, 23 bp, Artificial Sequence
  Description of Artificial Sequence: Synthetic primer
gtccttcagcatcttcttccaga

SEQ ID NO: 627 - DNA, 25 bp, Artificial Sequence
  Description of Artificial Sequence: Synthetic primer
cttgacttcgatgcactgattaaca

SEQ ID NO: 628 - DNA, 26 bp, Artificial Sequence
  Description of Artificial Sequence: Synthetic primer
cgattagctccctgatgatattacga

SEQ ID NO: 629 - DNA, 29 bp, Artificial Sequence
  Description of Artificial Sequence: Synthetic primer
gtaaaacccctgaatattgtcattaagct

SEQ ID NO: 630 - DNA, 26 bp, Artificial Sequence
  Description of Artificial Sequence: Synthetic primer
cgattagctccctgatgatattaact

SEQ ID NO: 631 - DNA, 26 bp, Artificial Sequence
  Description of Artificial Sequence: Synthetic primer
gattttgccagcaccataccaattga

SEQ ID NO: 632 - DNA, 27 bp, Artificial Sequence
  Description of Artificial Sequence: Synthetic primer
aattggttataaggagagagtatgcgt

SEQ ID NO: 633 - DNA, 26 bp, Artificial Sequence
  Description of Artificial Sequence: Synthetic primer
ctttttgccagcaccataccaatact

SEQ ID NO: 634 - DNA, 25 bp, Artificial Sequence
  Description of Artificial Sequence: Synthetic primer
cggttcgttttatctatcaggttca

SEQ ID NO: 635 - DNA, 22 bp, Artificial Sequence
  Description of Artificial Sequence: Synthetic primer
tatatccgcgccagtcagtttt

SEQ ID NO: 636 - DNA, 25 bp, Artificial Sequence
  Description of Artificial Sequence: Synthetic primer
cggttcgttttatttaagtggtagc

SEQ ID NO: 637 - DNA, 20 bp, Artificial Sequence
  Description of Artificial Sequence: Synthetic primer
cggatctgctatcgtgcctt

SEQ ID NO: 638 - DNA, 25 bp, Artificial Sequence
  Description of Artificial Sequence: Synthetic primer
aacagaccagtatcgagataatccg

SEQ ID NO: 639 - DNA, 20 bp, Artificial Sequence
  Description of Artificial Sequence: Synthetic primer
cggatctgctaagctgcttg

SEQ ID NO: 640 - DNA, 23 bp, Artificial Sequence
  Description of Artificial Sequence: Synthetic primer
gcgactcagaacgtatgcatctt

SEQ ID NO: 641 - DNA, 20 bp, Artificial Sequence
  Description of Artificial Sequence: Synthetic primer
gccaccttcaattccttccg

SEQ ID NO: 642 - DNA, 23 bp, Artificial Sequence
  Description of Artificial Sequence: Synthetic primer
gcgacagtgaaagaatgcatttg

SEQ ID NO: 643 - DNA, 23 bp, Artificial Sequence
  Description of Artificial Sequence: Synthetic primer
tgaacaagaaacacttccgcttt

SEQ ID NO: 644 - DNA, 23 bp, Artificial Sequence
  Description of Artificial Sequence: Synthetic primer
aattcaccatcgccaatatgcac

SEQ ID NO: 645 - DNA, 23 bp, Artificial Sequence
  Description of Artificial Sequence: Synthetic primer
tgaacaagaaacacttccgctta

SEQ ID NO: 646 - DNA, 24 bp, Artificial Sequence
  Description of Artificial Sequence: Synthetic primer
cgatcactttttggctcttactct

SEQ ID NO: 647 - DNA, 22 bp, Artificial Sequence
  Description of Artificial Sequence: Synthetic primer
gggtattgcgcgtagatttctc

SEQ ID NO: 648 - DNA, 24 bp, Artificial Sequence
  Description of Artificial Sequence: Synthetic primer
cgatcattgtttggcagttacagc

SEQ ID NO: 649 - DNA, 20 bp, Artificial Sequence
  Description of Artificial Sequence: Synthetic primer
gcaaaaagatggcctcgact

SEQ ID NO: 650 - DNA, 26 bp, Artificial Sequence
  Description of Artificial Sequence: Synthetic primer
gtcagctccattccttcttttttacg

SEQ ID NO: 651 - DNA, 20 bp, Artificial Sequence
  Description of Artificial Sequence: Synthetic primer
gcaaaaagatggcctcgaca

SEQ ID NO: 652 - DNA, 23 bp, Artificial Sequence
  Description of Artificial Sequence: Synthetic primer
atgatttcggccaagaggagagt

SEQ ID NO: 653 - DNA, 22 bp, Artificial Sequence
  Description of Artificial Sequence: Synthetic primer
cgccaatatcatccgcaacatt

SEQ ID NO: 654 - DNA, 23 bp, Artificial Sequence
  Description of Artificial Sequence: Synthetic primer
atgatttcggccaagaggagaga

SEQ ID NO: 655 - DNA, 30 bp, Artificial Sequence
  Description of Artificial Sequence: Synthetic primer
ggtaactgaatgctcttttttatgcattaa

SEQ ID NO: 656 - DNA, 26 bp, Artificial Sequence
  Description of Artificial Sequence: Synthetic primer
cttaaacgtgagaaacaggacgaatc

SEQ ID NO: 657 - DNA, 30 bp, Artificial Sequence
  Description of Artificial Sequence: Synthetic primer
ggtaactgaatgctcttttttatgcattac

SEQ ID NO: 658 - DNA, 26 bp, Artificial Sequence
  Description of Artificial Sequence: Synthetic primer
cgctttattttctctgaatcctggga

SEQ ID NO: 659 - DNA, 26 bp, Artificial Sequence
  Description of Artificial Sequence: Synthetic primer
ggaggttggatcttgtttttgtctac

SEQ ID NO: 660 - DNA, 26 bp, Artificial Sequence
  Description of Artificial Sequence: Synthetic primer
cgctttattttctcgctatcctgact

SEQ ID NO: 661 - DNA, 22 bp, Artificial Sequence
  Description of Artificial Sequence: Synthetic primer
ccagctaccggatatgtcttca

SEQ ID NO: 662 - DNA, 18 bp, Artificial Sequence
  Description of Artificial Sequence: Synthetic primer
gccgatccaaccgttagc

SEQ ID NO: 663 - DNA, 22 bp, Artificial Sequence
  Description of Artificial Sequence: Synthetic primer
ccagttaccggatatgagtagc

SEQ ID NO: 664 - DNA, 28 bp, Artificial Sequence
  Description of Artificial Sequence: Synthetic primer
gaattttcttgttgttctttcagattca

SEQ ID NO: 665 - DNA, 30 bp, Artificial Sequence
  Description of Artificial Sequence: Synthetic primer
ctatatacatcttcaaaaacaggcaaggtt

SEQ ID NO: 666 - DNA, 28 bp, Artificial Sequence
  Description of Artificial Sequence: Synthetic primer
gaattttcttgttgttctttcagatagc

SEQ ID NO: 667 - DNA, 21 bp, Artificial Sequence
  Description of Artificial Sequence: Synthetic primer
tcccggagtgtttcatctgat

SEQ ID NO: 668 - DNA, 20 bp, Artificial Sequence
  Description of Artificial Sequence: Synthetic primer
gcaaatcatctgcgcctctg

SEQ ID NO: 669 - DNA, 21 bp, Artificial Sequence
  Description of Artificial Sequence: Synthetic primer
tcccgtaacgtctcatcgctg

SEQ ID NO: 670 - DNA, 18 bp, Artificial Sequence
  Description of Artificial Sequence: Synthetic primer
gacggcgctttacccagt

SEQ ID NO: 671 - DNA, 18 bp, Artificial Sequence
  Description of Artificial Sequence: Synthetic primer
ggcaaacccggaaaaccg

SEQ ID NO: 672 - DNA, 18 bp, Artificial Sequence
  Description of Artificial Sequence: Synthetic primer
gacggcgctttacccagc

SEQ ID NO: 673 - DNA, 26 bp, Artificial Sequence
  Description of Artificial Sequence: Synthetic primer
gcttcctgacagtacaaaaacgacta

SEQ ID NO: 674 - DNA, 21 bp, Artificial Sequence
  Description of Artificial Sequence: Synthetic primer
cctaccaaacccgcactgatt

SEQ ID NO: 675 - DNA, 26 bp, Artificial Sequence
  Description of Artificial Sequence: Synthetic primer
gcttcctgacagtacaaaaaaggctc

SEQ ID NO: 676 - DNA, 29 bp, Artificial Sequence
  Description of Artificial Sequence: Synthetic primer
cctgaagagaagatttagtgatgagtaga

SEQ ID NO: 677 - DNA, 29 bp, Artificial Sequence
  Description of Artificial Sequence: Synthetic primer
ccatttagggctgatttattactacacac

SEQ ID NO: 678 - DNA, 29 bp, Artificial Sequence
  Description of Artificial Sequence: Synthetic primer
cctgcaaagaagatttagtgatcaacaat

SEQ ID NO: 679 - DNA, 20 bp, Artificial Sequence
  Description of Artificial Sequence: Synthetic primer
gttatgccgcgatcgtgaag

SEQ ID NO: 680 - DNA, 25 bp, Artificial Sequence
  Description of Artificial Sequence: Synthetic primer
atatcaccgacttttcccgtcttaa

SEQ ID NO: 681 - DNA, 20 bp, Artificial Sequence
  Description of Artificial Sequence: Synthetic primer
gttatgccgcgatcgtgtaa

SEQ ID NO: 682 - DNA, 25 bp, Artificial Sequence
  Description of Artificial Sequence: Synthetic primer
ctggcacaaaatatctggcagtttc

SEQ ID NO: 683 - DNA, 24 bp, Artificial Sequence
  Description of Artificial Sequence: Synthetic primer
aagacattgggattagcagcagta

SEQ ID NO: 684 - DNA, 25 bp, Artificial Sequence
  Description of Artificial Sequence: Synthetic primer
ctggcacaaaatatctggcagtttt

SEQ ID NO: 685 - DNA, 21 bp, Artificial Sequence
  Description of Artificial Sequence: Synthetic primer
gtcaaaccagccaaaaaccga

SEQ ID NO: 686 - DNA, 26 bp, Artificial Sequence
  Description of Artificial Sequence: Synthetic primer
tctgatgctgaacccactaaacttat

SEQ ID NO: 687 - DNA, 21 bp, Artificial Sequence
  Description of Artificial Sequence: Synthetic primer
gtcaaaccagccaaaaacgct

SEQ ID NO: 688 - DNA, 26 bp, Artificial Sequence
  Description of Artificial Sequence: Synthetic primer
gtcgaggactaccatgaacaagtttc

SEQ ID NO: 689 - DNA, 23 bp, Artificial Sequence
  Description of Artificial Sequence: Synthetic primer
gtttgcatcaccgtttgcatttt

SEQ ID NO: 690 - DNA, 26 bp, Artificial Sequence
  Description of Artificial Sequence: Synthetic primer
gtcgaggactaccatgaacaagtttt

SEQ ID NO: 691 - DNA, 23 bp, Artificial Sequence
  Description of Artificial Sequence: Synthetic primer
cagtgtttcagacggaatgagag

SEQ ID NO: 692 - DNA, 22 bp, Artificial Sequence
  Description of Artificial Sequence: Synthetic primer
aactactctgctcatggtcgtc

SEQ ID NO: 693 - DNA, 23 bp, Artificial Sequence
  Description of Artificial Sequence: Synthetic primer
cagtgtttcagacggaagcttaa

SEQ ID NO: 694 - DNA, 29 bp, Artificial Sequence
  Description of Artificial Sequence: Synthetic primer
gtaatgccaaatccttcagacttaaatga

SEQ ID NO: 695 - DNA, 24 bp, Artificial Sequence
  Description of Artificial Sequence: Synthetic primer
ggtatgtgttcttgatggcgaaat

SEQ ID NO: 696 - DNA, 29 bp, Artificial Sequence
  Description of Artificial Sequence: Synthetic primer
gtaatgccaaatccttcactcttaaagct

SEQ ID NO: 697 - DNA, 26 bp, Artificial Sequence
  Description of Artificial Sequence: Synthetic primer
tacaaataaccatctcatctgcctga

SEQ ID NO: 698 - DNA, 22 bp, Artificial Sequence
  Description of Artificial Sequence: Synthetic primer
ttgactcagaagggtgggttac

SEQ ID NO: 699 - DNA, 26 bp, Artificial Sequence
  Description of Artificial Sequence: Synthetic primer
tacaaataaccatctcatctgcctgc

SEQ ID NO: 700 - DNA, 21 bp, Artificial Sequence
  Description of Artificial Sequence: Synthetic primer
gcgatcgtaggagtttgatga

SEQ ID NO: 701 - DNA, 23 bp, Artificial Sequence
  Description of Artificial Sequence: Synthetic primer
gaccgctacaactcagaaaagac

SEQ ID NO: 702 - DNA, 21 bp, Artificial Sequence
  Description of Artificial Sequence: Synthetic primer
gcgatcgtaactgttgctgct

SEQ ID NO: 703 - DNA, 24 bp, Artificial Sequence
  Description of Artificial Sequence: Synthetic primer
caataatcgtaaaggggcagtttc

SEQ ID NO: 704 - DNA, 22 bp, Artificial Sequence
  Description of Artificial Sequence: Synthetic primer
gctgtagatgcggggagatatt

SEQ ID NO: 705 - DNA, 24 bp, Artificial Sequence
  Description of Artificial Sequence: Synthetic primer
caataatcgtaaaggggccgtcag

SEQ ID NO: 706 - DNA, 24 bp, Artificial Sequence
  Description of Artificial Sequence: Synthetic primer
ctttcatccatgtcatttgcctca

SEQ ID NO: 707 - DNA, 22 bp, Artificial Sequence
  Description of Artificial Sequence: Synthetic primer
ggtatcgtctggctgtattcgt

SEQ ID NO: 708 - DNA, 24 bp, Artificial Sequence
  Description of Artificial Sequence: Synthetic primer
ttaagctccatgtcatttgccagc

SEQ ID NO: 709 - DNA, 20 bp, Artificial Sequence
  Description of Artificial Sequence: Synthetic primer
tgtctttcaccgccatcaca

SEQ ID NO: 710 - DNA, 20 bp, Artificial Sequence
  Description of Artificial Sequence: Synthetic primer
gcacttccctcgtttgtcca

SEQ ID NO: 711 - DNA, 20 bp, Artificial Sequence
  Description of Artificial Sequence: Synthetic primer
tgtctttcaccgccatcact

SEQ ID NO: 712 - DNA, 31 bp, Artificial Sequence
  Description of Artificial Sequence: Synthetic primer
gcttctgataatactcttcataaattgagga

SEQ ID NO: 713 - DNA, 22 bp, Artificial Sequence
  Description of Artificial Sequence: Synthetic primer
gcagcctttaactccgataacc

SEQ ID NO: 714 - DNA, 31 bp, Artificial Sequence
  Description of Artificial Sequence: Synthetic primer
gcttctgataatactcttcataaatgctgct

SEQ ID NO: 715 - DNA, 24 bp, Artificial Sequence
  Description of Artificial Sequence: Synthetic primer
gggcttatcaatgtgaccctatca

SEQ ID NO: 716 - DNA, 24 bp, Artificial Sequence
  Description of Artificial Sequence: Synthetic primer
cggtcatgatttctgcaatacctg

SEQ ID NO: 717 - DNA, 24 bp, Artificial Sequence
  Description of Artificial Sequence: Synthetic primer
gggcttatcaatgtgaccttaagt

SEQ ID NO: 718 - DNA, 30 bp, Artificial Sequence
  Description of Artificial Sequence: Synthetic primer
cagtttgatcacttcgtcattaatagagag

SEQ ID NO: 719 - DNA, 19 bp, Artificial Sequence
  Description of Artificial Sequence: Synthetic primer
cggtctgtcactgattcgc

SEQ ID NO: 720 - DNA, 30 bp, Artificial Sequence
  Description of Artificial Sequence: Synthetic primer
cagtttgatcacttcgtcattaatagataa

SEQ ID NO: 721 - DNA, 25 bp, Artificial Sequence
  Description of Artificial Sequence: Synthetic primer
gaaccacagagagagtgaatgatga

SEQ ID NO: 722 - DNA, 31 bp, Artificial Sequence
  Description of Artificial Sequence: Synthetic primer
tgattgacaagggtattttttaagctatgaa

SEQ ID NO: 723 - DNA, 25 bp, Artificial Sequence
  Description of Artificial Sequence: Synthetic primer
gaaccacagataaagtgaagctact

SEQ ID NO: 724 - DNA, 19 bp, Artificial Sequence
  Description of Artificial Sequence: Synthetic primer
ggcgctcgatctgacactt

SEQ ID NO: 725 - DNA, 20 bp, Artificial Sequence
  Description of Artificial Sequence: Synthetic primer
tacggacagtgacagcgttg

SEQ ID NO: 726 - DNA, 19 bp, Artificial Sequence
  Description of Artificial Sequence: Synthetic primer
ggcgctcgatctgacattg

SEQ ID NO: 727 - DNA, 25 bp, Artificial Sequence
  Description of Artificial Sequence: Synthetic primer
ggaacgttttatgctggagtttctc

SEQ ID NO: 728 - DNA, 18 bp, Artificial Sequence
  Description of Artificial Sequence: Synthetic primer
tctgccgggtgatcttgc

SEQ ID NO: 729 - DNA, 25 bp, Artificial Sequence
  Description of Artificial Sequence: Synthetic primer
ggaacgttttatgctggagtttttg

SEQ ID NO: 730 - DNA, 20 bp, Artificial Sequence
  Description of Artificial Sequence: Synthetic primer
cggtgatgacgctatcttca

SEQ ID NO: 731 - DNA, 26 bp, Artificial Sequence
  Description of Artificial Sequence: Synthetic primer
ccatcaagggtaaagcgtgatttatc

SEQ ID NO: 732 - DNA, 20 bp, Artificial Sequence
  Description of Artificial Sequence: Synthetic primer
cggtgatgacgctaagcagt

SEQ ID NO: 733 - DNA, 29 bp, Artificial Sequence
  Description of Artificial Sequence: Synthetic primer
aaacaaagaaagatacaggctggaataag

SEQ ID NO: 734 - DNA, 22 bp, Artificial Sequence
  Description of Artificial Sequence: Synthetic primer
gtatcccactcagccctaatcg

SEQ ID NO: 735 - DNA, 29 bp, Artificial Sequence
  Description of Artificial Sequence: Synthetic primer
aaacacaaaaagatacaggctggaattaa

SEQ ID NO: 736 - DNA, 25 bp, Artificial Sequence
  Description of Artificial Sequence: Synthetic primer
tagatgacggttagtttcagcgaga

SEQ ID NO: 737 - DNA, 24 bp, Artificial Sequence
  Description of Artificial Sequence: Synthetic primer
tggaagatgcctgggaatatatgg

SEQ ID NO: 738 - DNA, 25 bp, Artificial Sequence
  Description of Artificial Sequence: Synthetic primer
taaatgacggttagtttcagcgagc

SEQ ID NO: 739 - DNA, 22 bp, Artificial Sequence
  Description of Artificial Sequence: Synthetic primer
gagaatggcaccgacgaaaatt

SEQ ID NO: 740 - DNA, 24 bp, Artificial Sequence
  Description of Artificial Sequence: Synthetic primer
gtcaaggtgttcaggcgtttattt

SEQ ID NO: 741 - DNA, 22 bp, Artificial Sequence
  Description of Artificial Sequence: Synthetic primer
gagaatggcaccgacgaaaata

SEQ ID NO: 742 - DNA, 21 bp, Artificial Sequence
  Description of Artificial Sequence: Synthetic primer
tgccgcagttttcattaggag

SEQ ID NO: 743 - DNA, 25 bp, Artificial Sequence
  Description of Artificial Sequence: Synthetic primer
catcaagctcaaaatggataactgg

SEQ ID NO: 744 - DNA, 21 bp, Artificial Sequence
  Description of Artificial Sequence: Synthetic primer
tgccgcagttttcatcaacaa

SEQ ID NO: 745 - DNA, 22 bp, Artificial Sequence
  Description of Artificial Sequence: Synthetic primer
cggacaactgaaaaggctgatg

SEQ ID NO: 746 - DNA, 31 bp, Artificial Sequence
  Description of Artificial Sequence: Synthetic primer
attttttacattttcgataaattcatctgca

SEQ ID NO: 747 - DNA, 22 bp, Artificial Sequence
  Description of Artificial Sequence: Synthetic primer
cggacaacactaaaggcgctac

SEQ ID NO: 748 - DNA, 25 bp, Artificial Sequence
  Description of Artificial Sequence: Synthetic primer
ctctacgtgctgattaacctgttgt

SEQ ID NO: 749 - DNA, 20 bp, Artificial Sequence
  Description of Artificial Sequence: Synthetic primer
gcatggctcccgaaaatcat

SEQ ID NO: 750 - DNA, 25 bp, Artificial Sequence
  Description of Artificial Sequence: Synthetic primer
ctctacgtgctgattaacctgttga

SEQ ID NO: 751 - DNA, 30 bp, Artificial Sequence
  Description of Artificial Sequence: Synthetic primer
tgtgaggagtggttatagaaataagaagtt

SEQ ID NO: 752 - DNA, 26 bp, Artificial Sequence
  Description of Artificial Sequence: Synthetic primer
gaaaactgtcgcctttaataccaatg

SEQ ID NO: 753 - DNA, 30 bp, Artificial Sequence
  Description of Artificial Sequence: Synthetic primer
tggctggagtggttatagaaataagaagtg

SEQ ID NO: 754 - DNA, 20 bp, Artificial Sequence
  Description of Artificial Sequence: Synthetic primer
gatgccatcgatgtgacctc

SEQ ID NO: 755 - DNA, 21 bp, Artificial Sequence
  Description of Artificial Sequence: Synthetic primer
ttcttcccagacagcatccag

SEQ ID NO: 756 - DNA, 20 bp, Artificial Sequence
  Description of Artificial Sequence: Synthetic primer
gatgccatcgatgtgaccag

SEQ ID NO: 757 - DNA, 27 bp, Artificial Sequence
  Description of Artificial Sequence: Synthetic primer
cgttcctggtaattgtatgaagattgt

SEQ ID NO: 758 - DNA, 24 bp, Artificial Sequence
  Description of Artificial Sequence: Synthetic primer
agccctatttacaccgatgatttc

SEQ ID NO: 759 - DNA, 27 bp, Artificial Sequence
  Description of Artificial Sequence: Synthetic primer
cgttcctggtaattgtatgaagattgc

SEQ ID NO: 760 - DNA, 25 bp, Artificial Sequence
  Description of Artificial Sequence: Synthetic primer
actgctatcttcaaatcgctgatct

SEQ ID NO: 761 - DNA, 25 bp, Artificial Sequence
  Description of Artificial Sequence: Synthetic primer
aacagagtcaacaacaacaacagac

SEQ ID NO: 762 - DNA, 25 bp, Artificial Sequence
  Description of Artificial Sequence: Synthetic primer
actgctatcttcaaatcgctgatca

SEQ ID NO: 763 - DNA, 21 bp, Artificial Sequence
  Description of Artificial Sequence: Synthetic primer
gcgccagttgtttcaggtatg

SEQ ID NO: 764 - DNA, 27 bp, Artificial Sequence
  Description of Artificial Sequence: Synthetic primer
cctatacccggaatatgtacattgtga

SEQ ID NO: 765 - DNA, 21 bp, Artificial Sequence
  Description of Artificial Sequence: Synthetic primer
gcgccagttgtttcaggtagc

SEQ ID NO: 766 - DNA, 19 bp, Artificial Sequence
  Description of Artificial Sequence: Synthetic primer
tcctgttctggaggggtca

SEQ ID NO: 767 - DNA, 24 bp, Artificial Sequence
  Description of Artificial Sequence: Synthetic primer
ggcaggaacatgttgatttcgatc

SEQ ID NO: 768 - DNA, 19 bp, Artificial Sequence
  Description of Artificial Sequence: Synthetic primer
tcctgttctggaggggagt

SEQ ID NO: 769 - DNA, 27 bp, Artificial Sequence
  Description of Artificial Sequence: Synthetic primer
cacgttcagtcattaaagattccatgt

SEQ ID NO: 770 - DNA, 27 bp, Artificial Sequence
  Description of Artificial Sequence: Synthetic primer
ccatttgcttttcctcatttagaatcg

SEQ ID NO: 771 - DNA, 27 bp, Artificial Sequence
  Description of Artificial Sequence: Synthetic primer
cacgttcagtcattaaagattccatga

SEQ ID NO: 772 - DNA, 21 bp, Artificial Sequence
  Description of Artificial Sequence: Synthetic primer
ggcacaacgtgacggtaatct

SEQ ID NO: 773 - DNA, 25 bp, Artificial Sequence
  Description of Artificial Sequence: Synthetic primer
gccacatactttattctcacccaga

SEQ ID NO: 774 - DNA, 21 bp, Artificial Sequence
  Description of Artificial Sequence: Synthetic primer
ggcacaacgtgacggtaatca

SEQ ID NO: 775 - DNA, 20 bp, Artificial Sequence
  Description of Artificial Sequence: Synthetic primer
cggggccaatacctcactac

SEQ ID NO: 776 - DNA, 23 bp, Artificial Sequence
  Description of Artificial Sequence: Synthetic primer
cggcatattcacgttcaacttca

SEQ ID NO: 777 - DNA, 20 bp, Artificial Sequence
  Description of Artificial Sequence: Synthetic primer
cggggccaataccagtttgt

SEQ ID NO: 778 - DNA, 29 bp, Artificial Sequence
  Description of Artificial Sequence: Synthetic primer
tcaacacctcagatgaagttattctttct

SEQ ID NO: 779 - DNA, 23 bp, Artificial Sequence
  Description of Artificial Sequence: Synthetic primer
tctattgccagattgacgaaagc

SEQ ID NO: 780 - DNA, 29 bp, Artificial Sequence
  Description of Artificial Sequence: Synthetic primer
tcaacaccagtgatgaagttattcttagc

SEQ ID NO: 781 - DNA, 31 bp, Artificial Sequence
  Description of Artificial Sequence: Synthetic primer
ttactttagcatattacgaatgacataatgt

SEQ ID NO: 782 - DNA, 20 bp, Artificial Sequence
  Description of Artificial Sequence: Synthetic primer
gcaccttcgccaatattcgc

SEQ ID NO: 783 - DNA, 31 bp, Artificial Sequence
  Description of Artificial Sequence: Synthetic primer
ttacttcaacatattacgaatgacataatgc

SEQ ID NO: 784 - DNA, 22 bp, Artificial Sequence
  Description of Artificial Sequence: Synthetic primer
gcgggaagaagatgaagcagta

SEQ ID NO: 785 - DNA, 24 bp, Artificial Sequence
  Description of Artificial Sequence: Synthetic primer
ttaccacctaaatgaagcggaaga

SEQ ID NO: 786 - DNA, 22 bp, Artificial Sequence
  Description of Artificial Sequence: Synthetic primer
gcgggaagaagatgaagcagtt

SEQ ID NO: 787 - DNA, 25 bp, Artificial Sequence
  Description of Artificial Sequence: Synthetic primer
atttcactttcccttctcgaaaagc

SEQ ID NO: 788 - DNA, 24 bp, Artificial Sequence
  Description of Artificial Sequence: Synthetic primer
tctgcgttgatgatttttcgtgtt

SEQ ID NO: 789 - DNA, 25 bp, Artificial Sequence
  Description of Artificial Sequence: Synthetic primer
atttcactttcccttctcgaaaagt

SEQ ID NO: 790 - DNA, 24 bp, Artificial Sequence
  Description of Artificial Sequence: Synthetic primer
tgaaagcatttgaaggtcatgcga

SEQ ID NO: 791 - DNA, 19 bp, Artificial Sequence
  Description of Artificial Sequence: Synthetic primer
ccgtgccattgaactgctg

SEQ ID NO: 792 - DNA, 24 bp, Artificial Sequence
  Description of Artificial Sequence: Synthetic primer
gctaagcatttgtaagtcatggct

SEQ ID NO: 793 - DNA, 18 bp, Artificial Sequence
  Description of Artificial Sequence: Synthetic primer
cgctacgaccgggaaaag

SEQ ID NO: 794 - DNA, 21 bp, Artificial Sequence
  Description of Artificial Sequence: Synthetic primer
gaagaagcaggtctgggtcag

SEQ ID NO: 795 - DNA, 18 bp, Artificial Sequence
  Description of Artificial Sequence: Synthetic primer
cgctacgaccgggaacaa

SEQ ID NO: 796 - DNA, 30 bp, Artificial Sequence
  Description of Artificial Sequence: Synthetic primer
attcactgaactgaaaaccatctggatatc

SEQ ID NO: 797 - DNA, 18 bp, Artificial Sequence
  Description of Artificial Sequence: Synthetic primer
ggagagcccggtatagcc

SEQ ID NO: 798 - DNA, 30 bp, Artificial Sequence
  Description of Artificial Sequence: Synthetic primer
attcactgaactgaaaaccatctggataag

SEQ ID NO: 799 - DNA, 25 bp, Artificial Sequence
  Description of Artificial Sequence: Synthetic primer
ccttctccctgaatcggaaatactt

SEQ ID NO: 800 - DNA, 30 bp, Artificial Sequence
  Description of Artificial Sequence: Synthetic primer
acattcgttttattttcttctttacagcct

SEQ ID NO: 801 - DNA, 25 bp, Artificial Sequence
  Description of Artificial Sequence: Synthetic primer
cttgttgcctgaaagcgaaatatta

SEQ ID NO: 802 - DNA, 24 bp, Artificial Sequence
  Description of Artificial Sequence: Synthetic primer
gagtatgaagatcgggcgattctt

SEQ ID NO: 803 - DNA, 27 bp, Artificial Sequence
  Description of Artificial Sequence: Synthetic primer
cagcgttttgatctctttacctacatc

SEQ ID NO: 804 - DNA, 24 bp, Artificial Sequence
  Description of Artificial Sequence: Synthetic primer
gagtatgaagatcgggcgatttta

SEQ ID NO: 805 - DNA, 27 bp, Artificial Sequence
  Description of Artificial Sequence: Synthetic primer
tccgataaattccattatgccggagta

SEQ ID NO: 806 - DNA, 23 bp, Artificial Sequence
  Description of Artificial Sequence: Synthetic primer
agtgcgtgatgaatggattgttg

SEQ ID NO: 807 - DNA, 27 bp, Artificial Sequence
  Description of Artificial Sequence: Synthetic primer
agtgataaattccattatgcaggtgtc

SEQ ID NO: 808 - DNA, 22 bp, Artificial Sequence
  Description of Artificial Sequence: Synthetic primer
cgtatttcggccatcagtgatg

SEQ ID NO: 809 - DNA, 21 bp, Artificial Sequence
  Description of Artificial Sequence: Synthetic primer
gtggattgacgatgacaaacc

SEQ ID NO: 810 - DNA, 22 bp, Artificial Sequence
  Description of Artificial Sequence: Synthetic primer
cgtatttcggccatcagactgc

SEQ ID NO: 811 - DNA, 25 bp, Artificial Sequence
  Description of Artificial Sequence: Synthetic primer
gctgaccaaatgaccagatatgaag

SEQ ID NO: 812 - DNA, 19 bp, Artificial Sequence
  Description of Artificial Sequence: Synthetic primer
gcgccaaactatgccgaag

SEQ ID NO: 813 - DNA, 25 bp, Artificial Sequence
  Description of Artificial Sequence: Synthetic primer
gctgaccaaaactccagatatgtaa

SEQ ID NO: 814 - DNA, 23 bp, Artificial Sequence
  Description of Artificial Sequence: Synthetic primer
gaagagatttatcgtggcacctc

SEQ ID NO: 815 - DNA, 22 bp, Artificial Sequence
  Description of Artificial Sequence: Synthetic primer
cggcggtgatctcagaaatttt

SEQ ID NO: 816 - DNA, 23 bp, Artificial Sequence
  Description of Artificial Sequence: Synthetic primer
gaagagatttatcgtggcaccag

SEQ ID NO: 817 - DNA, 24 bp, Artificial Sequence
  Description of Artificial Sequence: Synthetic primer
cttttcaaatacaacgatgctgga

SEQ ID NO: 818 - DNA, 23 bp, Artificial Sequence
  Description of Artificial Sequence: Synthetic primer
aagtcggggaactcttcttttga

SEQ ID NO: 819 - DNA, 24 bp, Artificial Sequence
  Description of Artificial Sequence: Synthetic primer
ttgttcaaatacaacgatgcaggt

SEQ ID NO: 820 - DNA, 24 bp, Artificial Sequence
  Description of Artificial Sequence: Synthetic primer
ctatctcttgaaccggtgatccta

SEQ ID NO: 821 - DNA, 22 bp, Artificial Sequence
  Description of Artificial Sequence: Synthetic primer
gcagcagtccataaccgaaaag

SEQ ID NO: 822 - DNA, 24 bp, Artificial Sequence
  Description of Artificial Sequence: Synthetic primer
ctaagccttgaaccggtgatcttg

SEQ ID NO: 823 - DNA, 22 bp, Artificial Sequence
  Description of Artificial Sequence: Synthetic primer
tttatccgcaaacgcatctgtc

SEQ ID NO: 824 - DNA, 22 bp, Artificial Sequence
  Description of Artificial Sequence: Synthetic primer
aaaggtggcaggatgtttacga

SEQ ID NO: 825 - DNA, 22 bp, Artificial Sequence
  Description of Artificial Sequence: Synthetic primer
tttatccgcaaacgcatctgag

SEQ ID NO: 826 - DNA, 26 bp, Artificial Sequence
  Description of Artificial Sequence: Synthetic primer
agaactcaccatcttttatcgcaatt

SEQ ID NO: 827 - DNA, 23 bp, Artificial Sequence
  Description of Artificial Sequence: Synthetic primer
caactcaccgaagaacagtacca

SEQ ID NO: 828 - DNA, 26 bp, Artificial Sequence
  Description of Artificial Sequence: Synthetic primer
agaactcaccatcttttatcgcaata

SEQ ID NO: 829 - DNA, 21 bp, Artificial Sequence
  Description of Artificial Sequence: Synthetic primer
ccggatcgtctacctctgcta

SEQ ID NO: 830 - DNA, 23 bp, Artificial Sequence
  Description of Artificial Sequence: Synthetic primer
gccaatggaaagctgatgtttca

SEQ ID NO: 831 - DNA, 21 bp, Artificial Sequence
  Description of Artificial Sequence: Synthetic primer
ccggatcgtttacctctgttg

SEQ ID NO: 832 - DNA, 29 bp, Artificial Sequence
  Description of Artificial Sequence: Synthetic primer
gttcacttcttgttgtttcatcattctca

SEQ ID NO: 833 - DNA, 27 bp, Artificial Sequence
  Description of Artificial Sequence: Synthetic primer
ctttaccaatacctgagatgtaaacgg

SEQ ID NO: 834 - DNA, 29 bp, Artificial Sequence
  Description of Artificial Sequence: Synthetic primer
gttcattgcttgttgtttcatcattcagt

SEQ ID NO: 835 - DNA, 28 bp, Artificial Sequence
  Description of Artificial Sequence: Synthetic primer
gattatctaccgctgtatctggagtatc

SEQ ID NO: 836 - DNA, 25 bp, Artificial Sequence
  Description of Artificial Sequence: Synthetic primer
gatattgattaagcggcgaagagtc

SEQ ID NO: 837 - DNA, 28 bp, Artificial Sequence
  Description of Artificial Sequence: Synthetic primer
gattatctaccgctgtatctggagtatt

SEQ ID NO: 838 - DNA, 26 bp, Artificial Sequence
  Description of Artificial Sequence: Synthetic primer
tcaatcagatgaccagagtactttga

SEQ ID NO: 839 - DNA, 21 bp, Artificial Sequence
  Description of Artificial Sequence: Synthetic primer
cgcgggatgatcaatatgctg

SEQ ID NO: 840 - DNA, 26 bp, Artificial Sequence
  Description of Artificial Sequence: Synthetic primer
tcaatcagatgaccgctgtacttact

SEQ ID NO: 841 - DNA, 22 bp, Artificial Sequence
  Description of Artificial Sequence: Synthetic primer
aaacaacaacgacgcaaccctt

SEQ ID NO: 842 - DNA, 23 bp, Artificial Sequence
  Description of Artificial Sequence: Synthetic primer
ttcgaaagcaaaatcatcacgca

SEQ ID NO: 843 - DNA, 22 bp, Artificial Sequence
  Description of Artificial Sequence: Synthetic primer
aaacaacaacgacgcaaccttg

SEQ ID NO: 844 - DNA, 31 bp, Artificial Sequence
  Description of Artificial Sequence: Synthetic primer
aaagttcaaaagagattatatcccttcttct

SEQ ID NO: 845 - DNA, 25 bp, Artificial Sequence
  Description of Artificial Sequence: Synthetic primer
cacgccatcctgatccatatgtata

SEQ ID NO: 846 - DNA, 31 bp, Artificial Sequence
  Description of Artificial Sequence: Synthetic primer
aaagttcaaaagagattatatcccttcttca

SEQ ID NO: 847 - DNA, 20 bp, Artificial Sequence
  Description of Artificial Sequence: Synthetic primer
ggcggtagggagttacgaag

SEQ ID NO: 848 - DNA, 25 bp, Artificial Sequence
  Description of Artificial Sequence: Synthetic primer
tttcatttgcttatgtgctggtcaa

SEQ ID NO: 849 - DNA, 20 bp, Artificial Sequence
  Description of Artificial Sequence: Synthetic primer
ggcggtagggagttacgtaa

SEQ ID NO: 850 - DNA, 31 bp, Artificial Sequence
  Description of Artificial Sequence: Synthetic primer
cttgttacaaagtaagaatgggagtttatga

SEQ ID NO: 851 - DNA, 23 bp, Artificial Sequence
  Description of Artificial Sequence: Synthetic primer
cgggttcacggctaaatgataac

SEQ ID NO: 852 - DNA, 31 bp, Artificial Sequence
  Description of Artificial Sequence: Synthetic primer
cttgttacaaagtaagaatgggagtttaact

SEQ ID NO: 853 - DNA, 30 bp, Artificial Sequence
  Description of Artificial Sequence: Synthetic primer
ttaaaatggataagaagcaagtaacggatc

SEQ ID NO: 854 - DNA, 21 bp, Artificial Sequence
  Description of Artificial Sequence: Synthetic primer
ccagtagcgggcgaatttatg

SEQ ID NO: 855 - DNA, 30 bp, Artificial Sequence
  Description of Artificial Sequence: Synthetic primer
ttaaaatggataagaagcaagtaacggatt

SEQ ID NO: 856 - DNA, 26 bp, Artificial Sequence
  Description of Artificial Sequence: Synthetic primer
tgaaattttcatccgtcagtttgaat

SEQ ID NO: 857 - DNA, 23 bp, Artificial Sequence
  Description of Artificial Sequence: Synthetic primer
cataatgtggtaaagcggtacac

SEQ ID NO: 858 - DNA, 26 bp, Artificial Sequence
  Description of Artificial Sequence: Synthetic primer
tgaaattttcatccgtcagtttgaaa

SEQ ID NO: 859 - DNA, 25 bp, Artificial Sequence
  Description of Artificial Sequence: Synthetic primer
atctggctggcacaatattactctt

SEQ ID NO: 860 - DNA, 22 bp, Artificial Sequence
  Description of Artificial Sequence: Synthetic primer
cgacgttattgccaggtgtaga

SEQ ID NO: 861 - DNA, 25 bp, Artificial Sequence
  Description of Artificial Sequence: Synthetic primer
atctggctggcacaatattactttg

SEQ ID NO: 862 - DNA, 22 bp, Artificial Sequence
  Description of Artificial Sequence: Synthetic primer
gctttcactttcgctgccacta

SEQ ID NO: 863 - DNA, 27 bp, Artificial Sequence
  Description of Artificial Sequence: Synthetic primer
ctttataagccgtgagtacttcttcaa

SEQ ID NO: 864 - DNA, 22 bp, Artificial Sequence
  Description of Artificial Sequence: Synthetic primer
gttgtcactttcgctgccattg

SEQ ID NO: 865 - DNA, 23 bp, Artificial Sequence
  Description of Artificial Sequence: Synthetic primer
gggtttgcaatggttacttctga

SEQ ID NO: 866 - DNA, 30 bp, Artificial Sequence
  Description of Artificial Sequence: Synthetic primer
gtctttaatcataccaataactcagatgcc

SEQ ID NO: 867 - DNA, 23 bp, Artificial Sequence
  Description of Artificial Sequence: Synthetic primer
gggtttgcaatggttacttcact

SEQ ID NO: 868 - DNA, 28 bp, Artificial Sequence
  Description of Artificial Sequence: Synthetic primer
cgttcatgcttactacgatattctatca

SEQ ID NO: 869 - DNA, 19 bp, Artificial Sequence
  Description of Artificial Sequence: Synthetic primer
gctgctgttctgactcggt

SEQ ID NO: 870 - DNA, 28 bp, Artificial Sequence
  Description of Artificial Sequence: Synthetic primer
cgttcatgcttactacgatattttgagc

SEQ ID NO: 871 - DNA, 18 bp, Artificial Sequence
  Description of Artificial Sequence: Synthetic primer
tggccatcgctgtctggt

SEQ ID NO: 872 - DNA, 23 bp, Artificial Sequence
  Description of Artificial Sequence: Synthetic primer
ggcaataaccgacacaataagcg

SEQ ID NO: 873 - DNA, 18 bp, Artificial Sequence
  Description of Artificial Sequence: Synthetic primer
tggccatcgctgtctgga

SEQ ID NO: 874 - DNA, 30 bp, Artificial Sequence
  Description of Artificial Sequence: Synthetic primer
gttctaaaggattttattgatgcactttcg

SEQ ID NO: 875 - DNA, 23 bp, Artificial Sequence
  Description of Artificial Sequence: Synthetic primer
gaatggcggtgataaggttagga

SEQ ID NO: 876 - DNA, 30 bp, Artificial Sequence
  Description of Artificial Sequence: Synthetic primer
gttttaaaggattttattgatgcacttagt

SEQ ID NO: 877 - DNA, 30 bp, Artificial Sequence
  Description of Artificial Sequence: Synthetic primer
ctacatccactaaatcattacaactcctga

SEQ ID NO: 878 - DNA, 20 bp, Artificial Sequence
  Description of Artificial Sequence: Synthetic primer
cgctactgggacgctatgaa

SEQ ID NO: 879 - DNA, 30 bp, Artificial Sequence
  Description of Artificial Sequence: Synthetic primer
ttacatccattaaatcattacaacagctag

SEQ ID NO: 880 - DNA, 20 bp, Artificial Sequence
  Description of Artificial Sequence: Synthetic primer
gtgttgctgtcgatccggta

SEQ ID NO: 881 - DNA, 26 bp, Artificial Sequence
  Description of Artificial Sequence: Synthetic primer
caagcggtgtctgtgagttattaatc

SEQ ID NO: 882 - DNA, 20 bp, Artificial Sequence
  Description of Artificial Sequence: Synthetic primer
gtgttgctgtcgatccggtg

SEQ ID NO: 883 - DNA, 20 bp, Artificial Sequence
  Description of Artificial Sequence: Synthetic primer
tcctgtgagcgcatacagtc

SEQ ID NO: 884 - DNA, 26 bp, Artificial Sequence
  Description of Artificial Sequence: Synthetic primer
agaagggtatgagtaataaggtggga

SEQ ID NO: 885 - DNA, 20 bp, Artificial Sequence
  Description of Artificial Sequence: Synthetic primer
tcctgtgagcgcatacagag

SEQ ID NO: 886 - DNA, 28 bp, Artificial Sequence
  Description of Artificial Sequence: Synthetic primer
tcactgagagttgtacgttgtagagaag

SEQ ID NO: 887 - DNA, 19 bp, Artificial Sequence
  Description of Artificial Sequence: Synthetic primer
cttgccgcctcctgttttg

SEQ ID NO: 888 - DNA, 28 bp, Artificial Sequence
  Description of Artificial Sequence: Synthetic primer
tcactgagagttgtacgttgtagagtaa

SEQ ID NO: 889 - DNA, 23 bp, Artificial Sequence
  Description of Artificial Sequence: Synthetic primer
cataattagaatgccgtgccatg

SEQ ID NO: 890 - DNA, 20 bp, Artificial Sequence
  Description of Artificial Sequence: Synthetic primer
gcctatccttccggtgcttt

SEQ ID NO: 891 - DNA, 23 bp, Artificial Sequence
  Description of Artificial Sequence: Synthetic primer
cataatcaaaatgccgtgccagc

SEQ ID NO: 892 - DNA, 20 bp, Artificial Sequence
  Description of Artificial Sequence: Synthetic primer
gcggaacccagataagcaag

SEQ ID NO: 893 - DNA, 18 bp, Artificial Sequence
  Description of Artificial Sequence: Synthetic primer
cgttttgccgccgagatc

SEQ ID NO: 894 - DNA, 20 bp, Artificial Sequence
  Description of Artificial Sequence: Synthetic primer
gcggaacccagataagctaa

SEQ ID NO: 895 - DNA, 28 bp, Artificial Sequence
  Description of Artificial Sequence: Synthetic primer
caaaatagggaataatcgaccacattga

SEQ ID NO: 896 - DNA, 20 bp, Artificial Sequence
  Description of Artificial Sequence: Synthetic primer
ctttggtcagtgtggcttgc

SEQ ID NO: 897 - DNA, 28 bp, Artificial Sequence
  Description of Artificial Sequence: Synthetic primer
caaaatagggaataatcgaccacatact

SEQ ID NO: 898 - DNA, 19 bp, Artificial Sequence
  Description of Artificial Sequence: Synthetic primer
caagggccgcagctttaag

SEQ ID NO: 899 - DNA, 24 bp, Artificial Sequence
  Description of Artificial Sequence: Synthetic primer
ggtactggactaaatacccatccg

SEQ ID NO: 900 - DNA, 19 bp, Artificial Sequence
  Description of Artificial Sequence: Synthetic primer
caagggccgcagcttttaa

SEQ ID NO: 901 - DNA, 23 bp, Artificial Sequence
  Description of Artificial Sequence: Synthetic primer
gcgatatatcccgaaagccctag

SEQ ID NO: 902 - DNA, 21 bp, Artificial Sequence
  Description of Artificial Sequence: Synthetic primer
tgcaaaccctgaaacggaatc

SEQ ID NO: 903 - DNA, 23 bp, Artificial Sequence
  Description of Artificial Sequence: Synthetic primer
gcgatatatccgcttaaccccaa

SEQ ID NO: 904 - DNA, 21 bp, Artificial Sequence
  Description of Artificial Sequence: Synthetic primer
cctgcaatcctcgaagcactc

SEQ ID NO: 905 - DNA, 20 bp, Artificial Sequence
  Description of Artificial Sequence: Synthetic primer
ccaaatacgccgtgcatcag

SEQ ID NO: 906 - DNA, 21 bp, Artificial Sequence
  Description of Artificial Sequence: Synthetic primer
cctgcaatcctcgaagcatta

SEQ ID NO: 907 - DNA, 28 bp, Artificial Sequence
  Description of Artificial Sequence: Synthetic primer
ttcgagtgatgagattttgcgaaattta

SEQ ID NO: 908 - DNA, 22 bp, Artificial Sequence
  Description of Artificial Sequence: Synthetic primer
aagtaagctctgcacttgtgga

SEQ ID NO: 909 - DNA, 28 bp, Artificial Sequence
  Description of Artificial Sequence: Synthetic primer
ttcgagtgaactgattttgcgaaatttt

SEQ ID NO: 910 - DNA, 18 bp, Artificial Sequence
  Description of Artificial Sequence: Synthetic primer
atcgcctcggtcgtttct

SEQ ID NO: 911 - DNA, 21 bp, Artificial Sequence
  Description of Artificial Sequence: Synthetic primer
catctgcaccgtcaaacagtg

SEQ ID NO: 912 - DNA, 18 bp, Artificial Sequence
  Description of Artificial Sequence: Synthetic primer
atcgcctcggtggtcagc

SEQ ID NO: 913 - DNA, 21 bp, Artificial Sequence
  Description of Artificial Sequence: Synthetic primer
ggcttgatccgaagaaaacct

SEQ ID NO: 914 - DNA, 19 bp, Artificial Sequence
  Description of Artificial Sequence: Synthetic primer
gccgcctgtagaccttctt

SEQ ID NO: 915 - DNA, 21 bp, Artificial Sequence
  Description of Artificial Sequence: Synthetic primer
ggttggatccgaagaaaacca

SEQ ID NO: 916 - DNA, 18 bp, Artificial Sequence
  Description of Artificial Sequence: Synthetic primer
tcacctgggagccattgg

SEQ ID NO: 917 - DNA, 19 bp, Artificial Sequence
  Description of Artificial Sequence: Synthetic primer
gtagctggtcagggcgtac

SEQ ID NO: 918 - DNA, 18 bp, Artificial Sequence
  Description of Artificial Sequence: Synthetic primer
tcacctgactgccattgc

SEQ ID NO: 919 - DNA, 22 bp, Artificial Sequence
  Description of Artificial Sequence: Synthetic primer
ctataccgattacccgacgcta

SEQ ID NO: 920 - DNA, 18 bp, Artificial Sequence
  Description of Artificial Sequence: Synthetic primer
cgcatcggttttggcgtt

SEQ ID NO: 921 - DNA, 22 bp, Artificial Sequence
  Description of Artificial Sequence: Synthetic primer
ctataccgattacccgacgttg

SEQ ID NO: 922 - DNA, 24 bp, Artificial Sequence
  Description of Artificial Sequence: Synthetic primer
gtcgcggaatttatgtaccagtca

SEQ ID NO: 923 - DNA, 25 bp, Artificial Sequence
  Description of Artificial Sequence: Synthetic primer
gacgaaatacttcatcagacaccca

SEQ ID NO: 924 - DNA, 24 bp, Artificial Sequence
  Description of Artificial Sequence: Synthetic primer
gtcgcggaatttatgtaccagagc

SEQ ID NO: 925 - DNA, 18 bp, Artificial Sequence
  Description of Artificial Sequence: Synthetic primer
gccgcatcttttggctca

SEQ ID NO: 926 - DNA, 20 bp, Artificial Sequence
  Description of Artificial Sequence: Synthetic primer
gggactggcacttcttctgg

SEQ ID NO: 927 - DNA, 18 bp, Artificial Sequence
  Description of Artificial Sequence: Synthetic primer
gccgcatcttttggcagc

SEQ ID NO: 928 - DNA, 23 bp, Artificial Sequence
  Description of Artificial Sequence: Synthetic primer
accagattgccctgaacttttca

SEQ ID NO: 929 - DNA, 22 bp, Artificial Sequence
  Description of Artificial Sequence: Synthetic primer
cccataggttcaacgaccagat

SEQ ID NO: 930 - DNA, 23 bp, Artificial Sequence
  Description of Artificial Sequence: Synthetic primer
accagattgccctgaactttagt

SEQ ID NO: 931 - DNA, 19 bp, Artificial Sequence
  Description of Artificial Sequence: Synthetic primer
gaaaggctggtcgtgcata

SEQ ID NO: 932 - DNA, 21 bp, Artificial Sequence
  Description of Artificial Sequence: Synthetic primer
tctattcgtcgcctacttgcc

SEQ ID NO: 933 - DNA, 19 bp, Artificial Sequence
  Description of Artificial Sequence: Synthetic primer
gaaaggctggtcgtgcatc

SEQ ID NO: 934 - DNA, 24 bp, Artificial Sequence
  Description of Artificial Sequence: Synthetic primer
cggttgtcattgttgaactcaagt

SEQ ID NO: 935 - DNA, 25 bp, Artificial Sequence
  Description of Artificial Sequence: Synthetic primer
gatgatcgaaaaatgtatccgtgca

SEQ ID NO: 936 - DNA, 24 bp, Artificial Sequence
  Description of Artificial Sequence: Synthetic primer
cggttgtcattgttgaactcgaga

SEQ ID NO: 937 - DNA, 29 bp, Artificial Sequence
  Description of Artificial Sequence: Synthetic primer
gctggaacacaataaaggtttttgtaact

SEQ ID NO: 938 - DNA, 18 bp, Artificial Sequence
  Description of Artificial Sequence: Synthetic primer
cgccgtgtgagcatttca

SEQ ID NO: 939 - DNA, 29 bp, Artificial Sequence
  Description of Artificial Sequence: Synthetic primer
gctggaacacaataaaggtttttgtaaca

SEQ ID NO: 940 - DNA, 21 bp, Artificial Sequence
  Description of Artificial Sequence: Synthetic primer
gcaattagcgtccgtagtgaa

SEQ ID NO: 941 - DNA, 21 bp, Artificial Sequence
  Description of Artificial Sequence: Synthetic primer
tgtccgtcgatgaagatcacc

SEQ ID NO: 942 - DNA, 21 bp, Artificial Sequence
  Description of Artificial Sequence: Synthetic primer
gcaattaacgtccgcaaactg

SEQ ID NO: 943 - DNA, 21 bp, Artificial Sequence
  Description of Artificial Sequence: Synthetic primer
gctcatctgtcccaacgatca

SEQ ID NO: 944 - DNA, 18 bp, Artificial Sequence
  Description of Artificial Sequence: Synthetic primer
cacactgccagaccgtag

SEQ ID NO: 945 - DNA, 21 bp, Artificial Sequence
  Description of Artificial Sequence: Synthetic primer
gctcatctgtcccaaagaagt

SEQ ID NO: 946 - DNA, 25 bp, Artificial Sequence
  Description of Artificial Sequence: Synthetic primer
tttgccgtcggtaatttctgtttta

SEQ ID NO: 947 - DNA, 26 bp, Artificial Sequence
  Description of Artificial Sequence: Synthetic primer
gtattgtgatgatgcaagtccagaaa

SEQ ID NO: 948 - DNA, 25 bp, Artificial Sequence
  Description of Artificial Sequence: Synthetic primer
tttgccgtcggtaatttctgttttt

SEQ ID NO: 949 - DNA, 26 bp, Artificial Sequence
  Description of Artificial Sequence: Synthetic primer
aacttaactctgtctgggtcttttca

SEQ ID NO: 950 - DNA, 22 bp, Artificial Sequence
  Description of Artificial Sequence: Synthetic primer
cgcgacagagaatttcatgacg

SEQ ID NO: 951 - DNA, 26 bp, Artificial Sequence
  Description of Artificial Sequence: Synthetic primer
aattaaacagcgtctgggtctttagc

SEQ ID NO: 952 - DNA, 20 bp, Artificial Sequence
  Description of Artificial Sequence: Synthetic primer
ccaccaccagatgttcagga

SEQ ID NO: 953 - DNA, 24 bp, Artificial Sequence
  Description of Artificial Sequence: Synthetic primer
gcgcaaactacttcttcaggtaaa

SEQ ID NO: 954 - DNA, 20 bp, Artificial Sequence
  Description of Artificial Sequence: Synthetic primer
ccaccaccagatgttcaggt

SEQ ID NO: 955 - DNA, 21 bp, Artificial Sequence
  Description of Artificial Sequence: Synthetic primer
aaggactggcgattgtgatgt

SEQ ID NO: 956 - DNA, 23 bp, Artificial Sequence
  Description of Artificial Sequence: Synthetic primer
agtgctgtgatgagaataaggca

SEQ ID NO: 957 - DNA, 21 bp, Artificial Sequence
  Description of Artificial Sequence: Synthetic primer
aaggactggcgattgtgatga

SEQ ID NO: 958 - DNA, 21 bp, Artificial Sequence
  Description of Artificial Sequence: Synthetic primer
cagctggacttctctcttcct

SEQ ID NO: 959 - DNA, 26 bp, Artificial Sequence
  Description of Artificial Sequence: Synthetic primer
aatcttctcattacgtaggtctgctt

SEQ ID NO: 960 - DNA, 21 bp, Artificial Sequence
  Description of Artificial Sequence: Synthetic primer
cagctggacttctctttgccg

SEQ ID NO: 961 - DNA, 19 bp, Artificial Sequence
  Description of Artificial Sequence: Synthetic primer
cgaccgtcggacaaccctt

SEQ ID NO: 962 - DNA, 22 bp, Artificial Sequence
  Description of Artificial Sequence: Synthetic primer
cacaagagatatgcaggacact

SEQ ID NO: 963 - DNA, 19 bp, Artificial Sequence
  Description of Artificial Sequence: Synthetic primer
cgaccgtcggacaacctta

SEQ ID NO: 964 - DNA, 29 bp, Artificial Sequence
  Description of Artificial Sequence: Synthetic primer
ggtataaaaatcacccaacctagaatacg

SEQ ID NO: 965 - DNA, 27 bp, Artificial Sequence
  Description of Artificial Sequence: Synthetic primer
cttatgattaagcgcctatcatatcgc

SEQ ID NO: 966 - DNA, 29 bp, Artificial Sequence
  Description of Artificial Sequence: Synthetic primer
ggtataaaaatcacccaacccaaaatcct

SEQ ID NO: 967 - DNA, 20 bp, Artificial Sequence
  Description of Artificial Sequence: Synthetic primer
gcatccctatggcgagtgat

SEQ ID NO: 968 - DNA, 23 bp, Artificial Sequence
  Description of Artificial Sequence: Synthetic primer
aaatgggcgaatactacaaaggc

SEQ ID NO: 969 - DNA, 20 bp, Artificial Sequence
  Description of Artificial Sequence: Synthetic primer
gcatccctatggccagactc

SEQ ID NO: 970 - DNA, 18 bp, Artificial Sequence
  Description of Artificial Sequence: Synthetic primer
cgacccctccccaaatga

SEQ ID NO: 971 - DNA, 23 bp, Artificial Sequence
  Description of Artificial Sequence: Synthetic primer
ggctgacagataatcgtcgatga

SEQ ID NO: 972 - DNA, 18 bp, Artificial Sequence
  Description of Artificial Sequence: Synthetic primer
cgacccctccccaaagct

SEQ ID NO: 973 - DNA, 23 bp, Artificial Sequence
  Description of Artificial Sequence: Synthetic primer
gctggaatcaaataaagccgaac

SEQ ID NO: 974 - DNA, 22 bp, Artificial Sequence
  Description of Artificial Sequence: Synthetic primer
ttattaccgcccatctcaaggg

SEQ ID NO: 975 - DNA, 23 bp, Artificial Sequence
  Description of Artificial Sequence: Synthetic primer
gctggaaagcaataaagccgaat

SEQ ID NO: 976 - DNA, 23 bp, Artificial Sequence
  Description of Artificial Sequence: Synthetic primer
gcatcgactatgaaatccgctca

SEQ ID NO: 977 - DNA, 27 bp, Artificial Sequence
  Description of Artificial Sequence: Synthetic primer
ggtggcaatgatgaaaagcagaatata

SEQ ID NO: 978 - DNA, 23 bp, Artificial Sequence
  Description of Artificial Sequence: Synthetic primer
gcatcgactatgaaatccgcagc

SEQ ID NO: 979 - DNA, 21 bp, Artificial Sequence
  Description of Artificial Sequence: Synthetic primer
ccatcaagcagacggtttagt

SEQ ID NO: 980 - DNA, 21 bp, Artificial Sequence
  Description of Artificial Sequence: Synthetic primer
aatgatggcggcaacaacttc

SEQ ID NO: 981 - DNA, 21 bp, Artificial Sequence
  Description of Artificial Sequence: Synthetic primer
ccatcaagcagcctgttcaac

SEQ ID NO: 982 - DNA, 23 bp, Artificial Sequence
  Description of Artificial Sequence: Synthetic primer
ctgatagcgacactgcttttctg

SEQ ID NO: 983 - DNA, 18 bp, Artificial Sequence
  Description of Artificial Sequence: Synthetic primer
ttcggcgatgaccgggat

SEQ ID NO: 984 - DNA, 23 bp, Artificial Sequence
  Description of Artificial Sequence: Synthetic primer
ctgatagcgacactgcttttcgc

SEQ ID NO: 985 - DNA, 27 bp, Artificial Sequence
  Description of Artificial Sequence: Synthetic primer
agtacccttgattactttaacctttga

SEQ ID NO: 986 - DNA, 21 bp, Artificial Sequence
  Description of Artificial Sequence: Synthetic primer
gtttctgctgggtggtattgg

SEQ ID NO: 987 - DNA, 27 bp, Artificial Sequence
  Description of Artificial Sequence: Synthetic primer
agtacccttgattactttaaccttgct

SEQ ID NO: 988 - DNA, 23 bp, Artificial Sequence
  Description of Artificial Sequence: Synthetic primer
gtttcattaccgacatgcccaag

SEQ ID NO: 989 - DNA, 25 bp, Artificial Sequence
  Description of Artificial Sequence: Synthetic primer
tggtcggtcaatggagattattcat

SEQ ID NO: 990 - DNA, 23 bp, Artificial Sequence
  Description of Artificial Sequence: Synthetic primer
gtttcattaccgacatgccctaa

SEQ ID NO: 991 - DNA, 26 bp, Artificial Sequence
  Description of Artificial Sequence: Synthetic primer
taatcagtattaagtcggcgaagtga

SEQ ID NO: 992 - DNA, 23 bp, Artificial Sequence
  Description of Artificial Sequence: Synthetic primer
atggcctggctatatcgttacac

SEQ ID NO: 993 - DNA, 26 bp, Artificial Sequence
  Description of Artificial Sequence: Synthetic primer
taatcagtattgagacggcgtaaact

SEQ ID NO: 994 - DNA, 25 bp, Artificial Sequence
  Description of Artificial Sequence: Synthetic primer
agaatctagccatcatctcaaactc

SEQ ID NO: 995 - DNA, 26 bp, Artificial Sequence
  Description of Artificial Sequence: Synthetic primer
aagttgtcgaaagtagattgcagatg

SEQ ID NO: 996 - DNA, 25 bp, Artificial Sequence
  Description of Artificial Sequence: Synthetic primer
agaatttggccatcatcagcaacag

SEQ ID NO: 997 - DNA, 22 bp, Artificial Sequence
  Description of Artificial Sequence: Synthetic primer
caataacggcaaccacgaaaga

SEQ ID NO: 998 - DNA, 23 bp, Artificial Sequence
  Description of Artificial Sequence: Synthetic primer
tgaccgtcaccaataactcgaat

SEQ ID NO: 999 - DNA, 22 bp, Artificial Sequence
  Description of Artificial Sequence: Synthetic primer
caataacggcaaccacgaagct

SEQ ID NO: 1000 - DNA, 28 bp, Artificial Sequence
  Description of Artificial Sequence: Synthetic primer
tgtttgataataataggcccattcagct

SEQ ID NO: 1001 - DNA, 18 bp, Artificial Sequence
  Description of Artificial Sequence: Synthetic primer
aatgccaccacgccacag

SEQ ID NO: 1002 - DNA, 28 bp, Artificial Sequence
  Description of Artificial Sequence: Synthetic primer
tgtttgataataataggcccattcagca

SEQ ID NO: 1003 - DNA, 20 bp, Artificial Sequence
  Description of Artificial Sequence: Synthetic primer
gaaccggatagacccagcga

SEQ ID NO: 1004 - DNA, 20 bp, Artificial Sequence
  Description of Artificial Sequence: Synthetic primer
cgatcaccgccaagcttatg

SEQ ID NO: 1005 - DNA, 20 bp, Artificial Sequence
  Description of Artificial Sequence: Synthetic primer
ctaccggataaacccaggct

SEQ ID NO: 1006 - DNA, 24 bp, Artificial Sequence
  Description of Artificial Sequence: Synthetic primer
tcttgaacagggtgcaattctctc

SEQ ID NO: 1007 - DNA, 19 bp, Artificial Sequence
  Description of Artificial Sequence: Synthetic primer
ttccaccacgaacagctct

SEQ ID NO: 1008 - DNA, 24 bp, Artificial Sequence
  Description of Artificial Sequence: Synthetic primer
tcttgaacagggtgcaattttaag

SEQ ID NO: 1009 - DNA, 31 bp, Artificial Sequence
  Description of Artificial Sequence: Synthetic primer
gataaaagatctcaatcagtactggttttct

SEQ ID NO: 1010 - DNA, 25 bp, Artificial Sequence
  Description of Artificial Sequence: Synthetic primer
acttatcaattttcagcacgtcagg

SEQ ID NO: 1011 - DNA, 31 bp, Artificial Sequence
  Description of Artificial Sequence: Synthetic primer
gataaaagatctcaatcagtactggtttagc

SEQ ID NO: 1012 - DNA, 23 bp, Artificial Sequence
  Description of Artificial Sequence: Synthetic primer
cagtgctctacatccaactttca

SEQ ID NO: 1013 - DNA, 24 bp, Artificial Sequence
  Description of Artificial Sequence: Synthetic primer
gaagacgccacgaatatctgattg

SEQ ID NO: 1014 - DNA, 23 bp, Artificial Sequence
  Description of Artificial Sequence: Synthetic primer
cagtgctctacatccaacttagc

SEQ ID NO: 1015 - DNA, 31 bp, Artificial Sequence
  Description of Artificial Sequence: Synthetic primer
agatatcaatattatctggccgatgatcctt

SEQ ID NO: 1016 - DNA, 19 bp, Artificial Sequence
  Description of Artificial Sequence: Synthetic primer
cttgccgcgggttttatgg

SEQ ID NO: 1017 - DNA, 31 bp, Artificial Sequence
  Description of Artificial Sequence: Synthetic primer
ggatatcaatattatctggccgatgatctta

SEQ ID NO: 1018 - DNA, 25 bp, Artificial Sequence
  Description of Artificial Sequence: Synthetic primer
agaaacgcgattacttcttttgagg

SEQ ID NO: 1019 - DNA, 27 bp, Artificial Sequence
  Description of Artificial Sequence: Synthetic primer
aaacagaattttacgcggatctaaatc

SEQ ID NO: 1020 - DNA, 25 bp, Artificial Sequence
  Description of Artificial Sequence: Synthetic primer
agaaacgcgattacttctttactgc

SEQ ID NO: 1021 - DNA, 20 bp, Artificial Sequence
  Description of Artificial Sequence: Synthetic primer
gaaagatgctcggcggttga

SEQ ID NO: 1022 - DNA, 23 bp, Artificial Sequence
  Description of Artificial Sequence: Synthetic primer
ccggcacctttaaccagtttatc

SEQ ID NO: 1023 - DNA, 20 bp, Artificial Sequence
  Description of Artificial Sequence: Synthetic primer
cttaaatgctcggcggtact

SEQ ID NO: 1024 - DNA, 22 bp, Artificial Sequence
  Description of Artificial Sequence: Synthetic primer
cgaggtcgttttatgcagagaa

SEQ ID NO: 1025 - DNA, 26 bp, Artificial Sequence
  Description of Artificial Sequence: Synthetic primer
tatgaaccaggctgtgaatatgctat

SEQ ID NO: 1026 - DNA, 22 bp, Artificial Sequence
  Description of Artificial Sequence: Synthetic primer
cgaggtcgttttatgcaggctg

SEQ ID NO: 1027 - DNA, 20 bp, Artificial Sequence
  Description of Artificial Sequence: Synthetic primer
tgctgggtatggactacgga

SEQ ID NO: 1028 - DNA, 22 bp, Artificial Sequence
  Description of Artificial Sequence: Synthetic primer
gctacaaaaatgcccgatcctc

SEQ ID NO: 1029 - DNA, 20 bp, Artificial Sequence
  Description of Artificial Sequence: Synthetic primer
tgctgggtatggactacggt

SEQ ID NO: 1030 - DNA, 30 bp, Artificial Sequence
  Description of Artificial Sequence: Synthetic primer
ggatttatcaaactcaggaatgtattctga

SEQ ID NO: 1031 - DNA, 18 bp, Artificial Sequence
  Description of Artificial Sequence: Synthetic primer
caaaactgccgcgtaccg

SEQ ID NO: 1032 - DNA, 30 bp, Artificial Sequence
  Description of Artificial Sequence: Synthetic primer
ggatttatcaaactcaggaatgtattcgct

SEQ ID NO: 1033 - DNA, 25 bp, Artificial Sequence
  Description of Artificial Sequence: Synthetic primer
ggtttcgattatatggaccgcaaac

SEQ ID NO: 1034 - DNA, 22 bp, Artificial Sequence
  Description of Artificial Sequence: Synthetic primer
gcgttatgccaaagtgattcca

SEQ ID NO: 1035 - DNA, 25 bp, Artificial Sequence
  Description of Artificial Sequence: Synthetic primer
ggtttcgattatatggaccgcaaat

SEQ ID NO: 1036 - DNA, 19 bp, Artificial Sequence
  Description of Artificial Sequence: Synthetic primer
gcgctcactaagtcctggt

SEQ ID NO: 1037 - DNA, 26 bp, Artificial Sequence
  Description of Artificial Sequence: Synthetic primer
tttagtgaagattttaccgcgcttag

SEQ ID NO: 1038 - DNA, 19 bp, Artificial Sequence
  Description of Artificial Sequence: Synthetic primer
gcgctcactaagtcctgga

SEQ ID NO: 1039 - DNA, 25 bp, Artificial Sequence
  Description of Artificial Sequence: Synthetic primer
ctgaatacccttaaaattgcctggt

SEQ ID NO: 1040 - DNA, 25 bp, Artificial Sequence
  Description of Artificial Sequence: Synthetic primer
cgcccaccagatcattttgatattc

SEQ ID NO: 1041 - DNA, 25 bp, Artificial Sequence
  Description of Artificial Sequence: Synthetic primer
ctgaataccttaaaaattgcctgga

SEQ ID NO: 1042 - DNA, 24 bp, Artificial Sequence
  Description of Artificial Sequence: Synthetic primer
atttgcggtaatcacaatcactca

SEQ ID NO: 1043 - DNA, 23 bp, Artificial Sequence
  Description of Artificial Sequence: Synthetic primer
caggatattcgtcatcagctcga

SEQ ID NO: 1044 - DNA, 24 bp, Artificial Sequence
  Description of Artificial Sequence: Synthetic primer
atttgcggtaatcacaatcacagt

SEQ ID NO: 1045 - DNA, 26 bp, Artificial Sequence
  Description of Artificial Sequence: Synthetic primer
ccaaacatgcctttcattagttctga

SEQ ID NO: 1046 - DNA, 31 bp, Artificial Sequence
  Description of Artificial Sequence: Synthetic primer
acaacttaaacatcttggtatggatattgac

SEQ ID NO: 1047 - DNA, 26 bp, Artificial Sequence
  Description of Artificial Sequence: Synthetic primer
ccaaacatgcctttcattaattcgct

SEQ ID NO: 1048 - DNA, 23 bp, Artificial Sequence
  Description of Artificial Sequence: Synthetic primer
cggaatgatggcactgatatgaa

SEQ ID NO: 1049 - DNA, 20 bp, Artificial Sequence
  Description of Artificial Sequence: Synthetic primer
gcccccctatttctgacacc

SEQ ID NO: 1050 - DNA, 23 bp, Artificial Sequence
  Description of Artificial Sequence: Synthetic primer
cggaatgatggcactgatatgac

SEQ ID NO: 1051 - DNA, 27 bp, Artificial Sequence
  Description of Artificial Sequence: Synthetic primer
tagtgatgacgccagagatgaatttct

SEQ ID NO: 1052 - DNA, 23 bp, Artificial Sequence
  Description of Artificial Sequence: Synthetic primer
aggctgcagtattttccaaaacg

SEQ ID NO: 1053 - DNA, 27 bp, Artificial Sequence
  Description of Artificial Sequence: Synthetic primer
tagtgatgacgccagagatgaatttca

SEQ ID NO: 1054 - DNA, 18 bp, Artificial Sequence
  Description of Artificial Sequence: Synthetic primer
cccgtccgctcgctaaac

SEQ ID NO: 1055 - DNA, 30 bp, Artificial Sequence
  Description of Artificial Sequence: Synthetic primer
catctctttttcattaagtttcagtcgaat

SEQ ID NO: 1056 - DNA, 18 bp, Artificial Sequence
  Description of Artificial Sequence: Synthetic primer
cccgtccgctcgctaaat

SEQ ID NO: 1057 - DNA, 31 bp, Artificial Sequence
  Description of Artificial Sequence: Synthetic primer
ttcagaatattcgctttctcaatatacctca

SEQ ID NO: 1058 - DNA, 21 bp, Artificial Sequence
  Description of Artificial Sequence: Synthetic primer
aattcgaaacctgcagcatgg

SEQ ID NO: 1059 - DNA, 31 bp, Artificial Sequence
  Description of Artificial Sequence: Synthetic primer
ttcagaatattcgcttagccaatataccagt

SEQ ID NO: 1060 - DNA, 28 bp, Artificial Sequence
  Description of Artificial Sequence: Synthetic primer
aacgtattatccatatcagctttcctct

SEQ ID NO: 1061 - DNA, 21 bp, Artificial Sequence
  Description of Artificial Sequence: Synthetic primer
agtgatgagcgtgtctgtagc

SEQ ID NO: 1062 - DNA, 28 bp, Artificial Sequence
  Description of Artificial Sequence: Synthetic primer
aacgtattatccatatcagttgagtagc

SEQ ID NO: 1063 - DNA, 30 bp, Artificial Sequence
  Description of Artificial Sequence: Synthetic primer
tatctaaaactttcctctaacggctatctc

SEQ ID NO: 1064 - DNA, 19 bp, Artificial Sequence
  Description of Artificial Sequence: Synthetic primer
gacatcttcggcggtgact

SEQ ID NO: 1065 - DNA, 30 bp, Artificial Sequence
  Description of Artificial Sequence: Synthetic primer
tatctaaaattaagcagtaacggctatttg

SEQ ID NO: 1066 - DNA, 20 bp, Artificial Sequence
  Description of Artificial Sequence: Synthetic primer
aacctccgtcacgctatcat

SEQ ID NO: 1067 - DNA, 19 bp, Artificial Sequence
  Description of Artificial Sequence: Synthetic primer
tacgcacttttccgccaga

SEQ ID NO: 1068 - DNA, 20 bp, Artificial Sequence
  Description of Artificial Sequence: Synthetic primer
aacctccgtcacgctaagca

SEQ ID NO: 1069 - DNA, 22 bp, Artificial Sequence
  Description of Artificial Sequence: Synthetic primer
gcgcattcctttcctgttttca

SEQ ID NO: 1070 - DNA, 24 bp, Artificial Sequence
  Description of Artificial Sequence: Synthetic primer
ccaaacatttcggtaaacatcggt

SEQ ID NO: 1071 - DNA, 22 bp, Artificial Sequence
  Description of Artificial Sequence: Synthetic primer
gcgcattcctttcctgtttagc

SEQ ID NO: 1072 - DNA, 30 bp, Artificial Sequence
  Description of Artificial Sequence: Synthetic primer
taattaccaacgctcttaaaacatctgacg

SEQ ID NO: 1073 - DNA, 22 bp, Artificial Sequence
  Description of Artificial Sequence: Synthetic primer
gctgtacgcgatttatattggc

SEQ ID NO: 1074 - DNA, 30 bp, Artificial Sequence
  Description of Artificial Sequence: Synthetic primer
taattaccaacgctcttaaaacatctgtct

SEQ ID NO: 1075 - DNA, 20 bp, Artificial Sequence
  Description of Artificial Sequence: Synthetic primer
tgaaacacccgccgaaaaac

SEQ ID NO: 1076 - DNA, 22 bp, Artificial Sequence
  Description of Artificial Sequence: Synthetic primer
accgccctgagatgaattagtg

SEQ ID NO: 1077 - DNA, 20 bp, Artificial Sequence
  Description of Artificial Sequence: Synthetic primer
tgaaacacccgccgaaaaat

SEQ ID NO: 1078 - DNA, 31 bp, Artificial Sequence
  Description of Artificial Sequence: Synthetic primer
gaacataactctattgctgagacttttaatc

SEQ ID NO: 1079 - DNA, 21 bp, Artificial Sequence
  Description of Artificial Sequence: Synthetic primer
gattcctagcccaaacatgcg

SEQ ID NO: 1080 - DNA, 31 bp, Artificial Sequence
  Description of Artificial Sequence: Synthetic primer
gaacataactctattgctgagacttttaatt

SEQ ID NO: 1081 - DNA, 25 bp, Artificial Sequence
  Description of Artificial Sequence: Synthetic primer
agagggttgtttattctgatcacga

SEQ ID NO: 1082 - DNA, 18 bp, Artificial Sequence
  Description of Artificial Sequence: Synthetic primer
caggcgctctctccacag

SEQ ID NO: 1083 - DNA, 25 bp, Artificial Sequence
  Description of Artificial Sequence: Synthetic primer
agagggttgtttattctgatcacgt

SEQ ID NO: 1084 - DNA, 24 bp, Artificial Sequence
  Description of Artificial Sequence: Synthetic primer
cgatgcttcctattcgtcgtgatt

SEQ ID NO: 1085 - DNA, 20 bp, Artificial Sequence
  Description of Artificial Sequence: Synthetic primer
accaccctgccctttttctt

SEQ ID NO: 1086 - DNA, 24 bp, Artificial Sequence
  Description of Artificial Sequence: Synthetic primer
cgatgttacctattcgtcgtgata

SEQ ID NO: 1087 - DNA, 22 bp, Artificial Sequence
  Description of Artificial Sequence: Synthetic primer
cgagctgtagttgataacctga

SEQ ID NO: 1088 - DNA, 21 bp, Artificial Sequence
  Description of Artificial Sequence: Synthetic primer
gcttgatgaaggccgtctttc

SEQ ID NO: 1089 - DNA, 22 bp, Artificial Sequence
  Description of Artificial Sequence: Synthetic primer
cgagctgcaattgataaccgct

SEQ ID NO: 1090 - DNA, 21 bp, Artificial Sequence
  Description of Artificial Sequence: Synthetic primer
ctatcaactctggacggctca

SEQ ID NO: 1091 - DNA, 18 bp, Artificial Sequence
  Description of Artificial Sequence: Synthetic primer
cgcccgttctgaatgtgc

SEQ ID NO: 1092 - DNA, 21 bp, Artificial Sequence
  Description of Artificial Sequence: Synthetic primer
ttaagtactctggacggcagc

SEQ ID NO: 1093 - DNA, 22 bp, Artificial Sequence
  Description of Artificial Sequence: Synthetic primer
gcggctatctggattattggct

SEQ ID NO: 1094 - DNA, 22 bp, Artificial Sequence
  Description of Artificial Sequence: Synthetic primer
gtcattttcgccattaccgctt

SEQ ID NO: 1095 - DNA, 22 bp, Artificial Sequence
  Description of Artificial Sequence: Synthetic primer
gcggctatctggattattggca

SEQ ID NO: 1096 - DNA, 21 bp, Artificial Sequence
  Description of Artificial Sequence: Synthetic primer
ggataccattcgcctgacctc

SEQ ID NO: 1097 - DNA, 20 bp, Artificial Sequence
  Description of Artificial Sequence: Synthetic primer
cgcaatcacatccagttcgg

SEQ ID NO: 1098 - DNA, 21 bp, Artificial Sequence
  Description of Artificial Sequence: Synthetic primer
ggataccattcgcctgaccag

SEQ ID NO: 1099 - DNA, 22 bp, Artificial Sequence
  Description of Artificial Sequence: Synthetic primer
cggctcaaaaggtacaggactt

SEQ ID NO: 1100 - DNA, 24 bp, Artificial Sequence
  Description of Artificial Sequence: Synthetic primer
gattcaccacctgtaccacaattc

SEQ ID NO: 1101 - DNA, 22 bp, Artificial Sequence
  Description of Artificial Sequence: Synthetic primer
cggcagtaaaggtacaggttta

SEQ ID NO: 1102 - DNA, 23 bp, Artificial Sequence
  Description of Artificial Sequence: Synthetic primer
tcgggttttctgaggtaagtttt

SEQ ID NO: 1103 - DNA, 23 bp, Artificial Sequence
  Description of Artificial Sequence: Synthetic primer
cacgtcgccagattgaagaaatt

SEQ ID NO: 1104 - DNA, 23 bp, Artificial Sequence
  Description of Artificial Sequence: Synthetic primer
tcgggttttcgctggtcaatttg

SEQ ID NO: 1105 - DNA, 20 bp, Artificial Sequence
  Description of Artificial Sequence: Synthetic primer
tcatcccctcagccatcctt

SEQ ID NO: 1106 - DNA, 19 bp, Artificial Sequence
  Description of Artificial Sequence: Synthetic primer
gccacggttctgctgattg

SEQ ID NO: 1107 - DNA, 20 bp, Artificial Sequence
  Description of Artificial Sequence: Synthetic primer
tcatccccagcgccatctta

SEQ ID NO: 1108 - DNA, 23 bp, Artificial Sequence
  Description of Artificial Sequence: Synthetic primer
tcaatagttaccagcgcgtttga

SEQ ID NO: 1109 - DNA, 21 bp, Artificial Sequence
  Description of Artificial Sequence: Synthetic primer
gcttcgcgtgggtgatatgta

SEQ ID NO: 1110 - DNA, 23 bp, Artificial Sequence
  Description of Artificial Sequence: Synthetic primer
tcaatagttaccagcgcgttact

SEQ ID NO: 1111 - DNA, 28 bp, Artificial Sequence
  Description of Artificial Sequence: Synthetic primer
gagtctttcttccagtattcatcgaaag

SEQ ID NO: 1112 - DNA, 21 bp, Artificial Sequence
  Description of Artificial Sequence: Synthetic primer
cacgaggtcaacttcatctgc

SEQ ID NO: 1113 - DNA, 28 bp, Artificial Sequence
  Description of Artificial Sequence: Synthetic primer
gagtctttcttccagtattcatcgaagc

SEQ ID NO: 1114 - DNA, 20 bp, Artificial Sequence
  Description of Artificial Sequence: Synthetic primer
agcctgcccgttatttctca

SEQ ID NO: 1115 - DNA, 24 bp, Artificial Sequence
  Description of Artificial Sequence: Synthetic primer
gtatgttccggccattgtagaatc

SEQ ID NO: 1116 - DNA, 20 bp, Artificial Sequence
  Description of Artificial Sequence: Synthetic primer
agcctgcccgttatttcagc

SEQ ID NO: 1117 - DNA, 21 bp, Artificial Sequence
  Description of Artificial Sequence: Synthetic primer
cgtttttattcccgctcctca

SEQ ID NO: 1118 - DNA, 19 bp, Artificial Sequence
  Description of Artificial Sequence: Synthetic primer
caatgccagagccaacgac

SEQ ID NO: 1119 - DNA, 21 bp, Artificial Sequence
  Description of Artificial Sequence: Synthetic primer
cgtttttattcccgcagcagt

SEQ ID NO: 1120 - DNA, 28 bp, Artificial Sequence
  Description of Artificial Sequence: Synthetic primer
caaactatatgaagccaaaaaccgtctt

SEQ ID NO: 1121 - DNA, 19 bp, Artificial Sequence
  Description of Artificial Sequence: Synthetic primer
cagggtaaacgcgggaagt

SEQ ID NO: 1122 - DNA, 28 bp, Artificial Sequence
  Description of Artificial Sequence: Synthetic primer
caaattgtatgaagccaaaaaccgttta

SEQ ID NO: 1123 - DNA, 27 bp, Artificial Sequence
  Description of Artificial Sequence: Synthetic primer
aagatgtgagtatgggtcgttaaaaag

SEQ ID NO: 1124 - DNA, 18 bp, Artificial Sequence
  Description of Artificial Sequence: Synthetic primer
cagccacctccgattcct

SEQ ID NO: 1125 - DNA, 27 bp, Artificial Sequence
  Description of Artificial Sequence: Synthetic primer
caaatggctgtatgggtcgttaaacaa

SEQ ID NO: 1126 - DNA, 22 bp, Artificial Sequence
  Description of Artificial Sequence: Synthetic primer
gcatcagggccagtgaaaaaag

SEQ ID NO: 1127 - DNA, 21 bp, Artificial Sequence
  Description of Artificial Sequence: Synthetic primer
tgctcgccctaaccgttatac

SEQ ID NO: 1128 - DNA, 22 bp, Artificial Sequence
  Description of Artificial Sequence: Synthetic primer
gcatcagggccaggctaaataa

SEQ ID NO: 1129 - DNA, 22 bp, Artificial Sequence
  Description of Artificial Sequence: Synthetic primer
cggtcgtattttctctggctct

SEQ ID NO: 1130 - DNA, 20 bp, Artificial Sequence
  Description of Artificial Sequence: Synthetic primer
tcggtcgattgagtgacagc

SEQ ID NO: 1131 - DNA, 22 bp, Artificial Sequence
  Description of Artificial Sequence: Synthetic primer
cggtcgtattttcagtggcagc

SEQ ID NO: 1132 - DNA, 30 bp, Artificial Sequence
  Description of Artificial Sequence: Synthetic primer
gtgagaatattagataggttgagcagagaa

SEQ ID NO: 1133 - DNA, 25 bp, Artificial Sequence
  Description of Artificial Sequence: Synthetic primer
cgtcttgcatcacttcacctttaag

SEQ ID NO: 1134 - DNA, 30 bp, Artificial Sequence
  Description of Artificial Sequence: Synthetic primer
gtgagaatattacttaagttcaacagactt

SEQ ID NO: 1135 - DNA, 19 bp, Artificial Sequence
  Description of Artificial Sequence: Synthetic primer
ccagggccgcttcttttga

SEQ ID NO: 1136 - DNA, 21 bp, Artificial Sequence
  Description of Artificial Sequence: Synthetic primer
ccacccattgagtgacctgaa

SEQ ID NO: 1137 - DNA, 19 bp, Artificial Sequence
  Description of Artificial Sequence: Synthetic primer
ccagggccgcttctttact

SEQ ID NO: 1138 - DNA, 22 bp, Artificial Sequence
  Description of Artificial Sequence: Synthetic primer
cggtgtacggaataatcagtga

SEQ ID NO: 1139 - DNA, 24 bp, Artificial Sequence
  Description of Artificial Sequence: Synthetic primer
ggtttacttcctgatgacctcact

SEQ ID NO: 1140 - DNA, 22 bp, Artificial Sequence
  Description of Artificial Sequence: Synthetic primer
cggtgtacggaataatcaggct

SEQ ID NO: 1141 - DNA, 21 bp, Artificial Sequence
  Description of Artificial Sequence: Synthetic primer
aaactctgcgtcaccctttcc

SEQ ID NO: 1142 - DNA, 20 bp, Artificial Sequence
  Description of Artificial Sequence: Synthetic primer
cgcattttcggctatttcgc

SEQ ID NO: 1143 - DNA, 21 bp, Artificial Sequence
  Description of Artificial Sequence: Synthetic primer
aaactctgcgtcaccttaagt

SEQ ID NO: 1144 - DNA, 30 bp, Artificial Sequence
  Description of Artificial Sequence: Synthetic primer
gttcacagtgtccttgcattatctttgatt

SEQ ID NO: 1145 - DNA, 20 bp, Artificial Sequence
  Description of Artificial Sequence: Synthetic primer
tgcggacgatcggtaatacc

SEQ ID NO: 1146 - DNA, 30 bp, Artificial Sequence
  Description of Artificial Sequence: Synthetic primer
gtagtcagtgtccttgcattatctttgata

SEQ ID NO: 1147 - DNA, 22 bp, Artificial Sequence
  Description of Artificial Sequence: Synthetic primer
ctcaggattcgcccatatctcc

SEQ ID NO: 1148 - DNA, 20 bp, Artificial Sequence
  Description of Artificial Sequence: Synthetic primer
atttccggcatcatcaacgc

SEQ ID NO: 1149 - DNA, 22 bp, Artificial Sequence
  Description of Artificial Sequence: Synthetic primer
ctcaggattcgcccatatcagt

SEQ ID NO: 1150 - DNA, 21 bp, Artificial Sequence
  Description of Artificial Sequence: Synthetic primer
cgtaatcttcctgccgtgacg

SEQ ID NO: 1151 - DNA, 25 bp, Artificial Sequence
  Description of Artificial Sequence: Synthetic primer
acgtttgtgctggtgaaagataaaa

SEQ ID NO: 1152 - DNA, 21 bp, Artificial Sequence
  Description of Artificial Sequence: Synthetic primer
cgtaatcttcctgccgtgaac

SEQ ID NO: 1153 - DNA, 24 bp, Artificial Sequence
  Description of Artificial Sequence: Synthetic primer
gtacagacagaagagaatggacga

SEQ ID NO: 1154 - DNA, 18 bp, Artificial Sequence
  Description of Artificial Sequence: Synthetic primer
gtttgtgggctgcgtgtc

SEQ ID NO: 1155 - DNA, 24 bp, Artificial Sequence
  Description of Artificial Sequence: Synthetic primer
gtacagacagaagagaatggagct

SEQ ID NO: 1156 - DNA, 18 bp, Artificial Sequence
  Description of Artificial Sequence: Synthetic primer
gcagggtaagggtgcttc

SEQ ID NO: 1157 - DNA, 29 bp, Artificial Sequence
  Description of Artificial Sequence: Synthetic primer
gctttaactttgatttctttaccgtcaac

SEQ ID NO: 1158 - DNA, 18 bp, Artificial Sequence
  Description of Artificial Sequence: Synthetic primer
gcagggtaagggtgcgag

SEQ ID NO: 1159 - DNA, 22 bp, Artificial Sequence
  Description of Artificial Sequence: Synthetic primer
tggacactactgctggcaatct

SEQ ID NO: 1160 - DNA, 23 bp, Artificial Sequence
  Description of Artificial Sequence: Synthetic primer
gcacatcacgctcaactgaatag

SEQ ID NO: 1161 - DNA, 22 bp, Artificial Sequence
  Description of Artificial Sequence: Synthetic primer
tggacattactgctggcaatca

SEQ ID NO: 1162 - DNA, 27 bp, Artificial Sequence
  Description of Artificial Sequence: Synthetic primer
tatccatagcaggttttgatggtaaga

SEQ ID NO: 1163 - DNA, 18 bp, Artificial Sequence
  Description of Artificial Sequence: Synthetic primer
gtgcgacctgtccggatt

SEQ ID NO: 1164 - DNA, 27 bp, Artificial Sequence
  Description of Artificial Sequence: Synthetic primer
tatccataacaggttttgatggtagct

SEQ ID NO: 1165 - DNA, 24 bp, Artificial Sequence
  Description of Artificial Sequence: Synthetic primer
aatctaacttctcgctgcaactct

SEQ ID NO: 1166 - DNA, 26 bp, Artificial Sequence
  Description of Artificial Sequence: Synthetic primer
gcttcaaaacgatcctcttctgaaag

SEQ ID NO: 1167 - DNA, 24 bp, Artificial Sequence
  Description of Artificial Sequence: Synthetic primer
aatctaacttctcgctgcaactca

SEQ ID NO: 1168 - DNA, 25 bp, Artificial Sequence
  Description of Artificial Sequence: Synthetic primer
tcgtcaccagaagcacaatgataag

SEQ ID NO: 1169 - DNA, 30 bp, Artificial Sequence
  Description of Artificial Sequence: Synthetic primer
ttttttttacccttctttacacacttttca

SEQ ID NO: 1170 - DNA, 25 bp, Artificial Sequence
  Description of Artificial Sequence: Synthetic primer
tcgtcaccagtaacacaatgatcaa

SEQ ID NO: 1171 - DNA, 21 bp, Artificial Sequence
  Description of Artificial Sequence: Synthetic primer
cgtctactggcagatcagcta

SEQ ID NO: 1172 - DNA, 18 bp, Artificial Sequence
  Description of Artificial Sequence: Synthetic primer
cggacacgctcggcataa

SEQ ID NO: 1173 - DNA, 21 bp, Artificial Sequence
  Description of Artificial Sequence: Synthetic primer
cgtttgctggcagatcagttg

SEQ ID NO: 1174 - DNA, 20 bp, Artificial Sequence
  Description of Artificial Sequence: Synthetic primer
accgcaccattgaactctca

SEQ ID NO: 1175 - DNA, 28 bp, Artificial Sequence
  Description of Artificial Sequence: Synthetic primer
cgatttctttgagtactacggacagata

SEQ ID NO: 1176 - DNA, 20 bp, Artificial Sequence
  Description of Artificial Sequence: Synthetic primer
accgcaccattgaactcagt

SEQ ID NO: 1177 - DNA, 24 bp, Artificial Sequence
  Description of Artificial Sequence: Synthetic primer
tagtttcagtttgcccttttcaga

SEQ ID NO: 1178 - DNA, 22 bp, Artificial Sequence
  Description of Artificial Sequence: Synthetic primer
cttaatcgggttcttccagtgc

SEQ ID NO: 1179 - DNA, 24 bp, Artificial Sequence
  Description of Artificial Sequence: Synthetic primer
caatttcagtttgcccttttcgct

SEQ ID NO: 1180 - DNA, 27 bp, Artificial Sequence
  Description of Artificial Sequence: Synthetic primer
ttgatagatgagatttccgtttttgaa

SEQ ID NO: 1181 - DNA, 22 bp, Artificial Sequence
  Description of Artificial Sequence: Synthetic primer
agctcttttcgtcactccttga

SEQ ID NO: 1182 - DNA, 27 bp, Artificial Sequence
  Description of Artificial Sequence: Synthetic primer
ttgatgctactgatttccgttttgctt

SEQ ID NO: 1183 - DNA, 23 bp, Artificial Sequence
  Description of Artificial Sequence: Synthetic primer
agacacttctacggtgcaacttt

SEQ ID NO: 1184 - DNA, 20 bp, Artificial Sequence
  Description of Artificial Sequence: Synthetic primer
cgaaagaaaccctgccgtct

SEQ ID NO: 1185 - DNA, 23 bp, Artificial Sequence
  Description of Artificial Sequence: Synthetic primer
agacacttctacggtgcaactta

SEQ ID NO: 1186 - DNA, 20 bp, Artificial Sequence
  Description of Artificial Sequence: Synthetic primer
ccattgcccatcagcgattg

SEQ ID NO: 1187 - DNA, 31 bp, Artificial Sequence
  Description of Artificial Sequence: Synthetic primer
tcttgaacggcataataggttagataaattg

SEQ ID NO: 1188 - DNA, 20 bp, Artificial Sequence
  Description of Artificial Sequence: Synthetic primer
ccattgcccatcagcgatac

SEQ ID NO: 1189 - DNA, 20 bp, Artificial Sequence
  Description of Artificial Sequence: Synthetic primer
cgcaggaagtggaagtctca

SEQ ID NO: 1190 - DNA, 23 bp, Artificial Sequence
  Description of Artificial Sequence: Synthetic primer
ttcttgacctggagaaatcacgt

SEQ ID NO: 1191 - DNA, 20 bp, Artificial Sequence
  Description of Artificial Sequence: Synthetic primer
cgcaggaagtggaagtcagt

SEQ ID NO: 1192 - DNA, 23 bp, Artificial Sequence
  Description of Artificial Sequence: Synthetic primer
tgttccgccagatagaagaatca

SEQ ID NO: 1193 - DNA, 26 bp, Artificial Sequence
  Description of Artificial Sequence: Synthetic primer
gtggttctggtagatgtatttcgaga

SEQ ID NO: 1194 - DNA, 23 bp, Artificial Sequence
  Description of Artificial Sequence: Synthetic primer
tgttccgccagatagaagaaagc

SEQ ID NO: 1195 - DNA, 23 bp, Artificial Sequence
  Description of Artificial Sequence: Synthetic primer
gacatccagcagtcgagcattag

SEQ ID NO: 1196 - DNA, 21 bp, Artificial Sequence
  Description of Artificial Sequence: Synthetic primer
cctgtattactccggctctgg

SEQ ID NO: 1197 - DNA, 23 bp, Artificial Sequence
  Description of Artificial Sequence: Synthetic primer
ctcatccagcagtcgagcattaa

SEQ ID NO: 1198 - DNA, 22 bp, Artificial Sequence
  Description of Artificial Sequence: Synthetic primer
tactatgcagggctcgcaactt

SEQ ID NO: 1199 - DNA, 25 bp, Artificial Sequence
  Description of Artificial Sequence: Synthetic primer
tcggaatgaattgagatatcgcctt

SEQ ID NO: 1200 - DNA, 22 bp, Artificial Sequence
  Description of Artificial Sequence: Synthetic primer
tactatgcagggctcgcaatta

SEQ ID NO: 1201 - DNA, 23 bp, Artificial Sequence
  Description of Artificial Sequence: Synthetic primer
gcaatccataccagcacatagga

SEQ ID NO: 1202 - DNA, 18 bp, Artificial Sequence
  Description of Artificial Sequence: Synthetic primer
gcgcaactatccctgggt

SEQ ID NO: 1203 - DNA, 23 bp, Artificial Sequence
  Description of Artificial Sequence: Synthetic primer
gcaatccataccagcacataact

SEQ ID NO: 1204 - DNA, 25 bp, Artificial Sequence
  Description of Artificial Sequence: Synthetic primer
gaatttagagtcacgttcaccacaa

SEQ ID NO: 1205 - DNA, 22 bp, Artificial Sequence
  Description of Artificial Sequence: Synthetic primer
ttgcctcactcaatgacgatca

SEQ ID NO: 1206 - DNA, 25 bp, Artificial Sequence
  Description of Artificial Sequence: Synthetic primer
gaatttgctgtcacgttcaccacat

SEQ ID NO: 1207 - DNA, 24 bp, Artificial Sequence
  Description of Artificial Sequence: Synthetic primer
gtctaccacttatccagtcttcgc

SEQ ID NO: 1208 - DNA, 19 bp, Artificial Sequence
  Description of Artificial Sequence: Synthetic primer
gttatccggggcatagcgt

SEQ ID NO: 1209 - DNA, 24 bp, Artificial Sequence
  Description of Artificial Sequence: Synthetic primer
gtttgccacttatccagtcttcgt

SEQ ID NO: 1210 - DNA, 28 bp, Artificial Sequence
  Description of Artificial Sequence: Synthetic primer
gtgaagcagtggtgataactagaataga

SEQ ID NO: 1211 - DNA, 27 bp, Artificial Sequence
  Description of Artificial Sequence: Synthetic primer
ttggtcaatatgaaatagcttgatggc

SEQ ID NO: 1212 - DNA, 28 bp, Artificial Sequence
  Description of Artificial Sequence: Synthetic primer
gtgaagcagtggtgataactaaaatact

SEQ ID NO: 1213 - DNA, 21 bp, Artificial Sequence
  Description of Artificial Sequence: Synthetic primer
ggattgtgaccatctctgcac

SEQ ID NO: 1214 - DNA, 23 bp, Artificial Sequence
  Description of Artificial Sequence: Synthetic primer
ccgtctttggtttctgctttttg

SEQ ID NO: 1215 - DNA, 21 bp, Artificial Sequence
  Description of Artificial Sequence: Synthetic primer
ggattgtgaccatctctgcat

SEQ ID NO: 1216 - DNA, 26 bp, Artificial Sequence
  Description of Artificial Sequence: Synthetic primer
cggaaatatttgatggcagactgtag

SEQ ID NO: 1217 - DNA, 19 bp, Artificial Sequence
  Description of Artificial Sequence: Synthetic primer
cggtggtatgcgtgatggt

SEQ ID NO: 1218 - DNA, 26 bp, Artificial Sequence
  Description of Artificial Sequence: Synthetic primer
cggaaatatttgatggcgctctgtaa

SEQ ID NO: 1219 - DNA, 23 bp, Artificial Sequence
  Description of Artificial Sequence: Synthetic primer
ccgccaggggtaataaattctga

SEQ ID NO: 1220 - DNA, 27 bp, Artificial Sequence
  Description of Artificial Sequence: Synthetic primer
gcacgtcagcataatctcattatcttc

SEQ ID NO: 1221 - DNA, 23 bp, Artificial Sequence
  Description of Artificial Sequence: Synthetic primer
ccgccaggggtaataaattcact

SEQ ID NO: 1222 - DNA, 30 bp, Artificial Sequence
  Description of Artificial Sequence: Synthetic primer
gataatttgattaatttcgttggcagaaag

SEQ ID NO: 1223 - DNA, 20 bp, Artificial Sequence
  Description of Artificial Sequence: Synthetic primer
gcgcttcatgtttcctggtc

SEQ ID NO: 1224 - DNA, 30 bp, Artificial Sequence
  Description of Artificial Sequence: Synthetic primer
gataatttgattaatttcgttggcgctcaa

SEQ ID NO: 1225 - DNA, 21 bp, Artificial Sequence
  Description of Artificial Sequence: Synthetic primer
cggctgacccagtacaaggag

SEQ ID NO: 1226 - DNA, 23 bp, Artificial Sequence
  Description of Artificial Sequence: Synthetic primer
tgggaacgtatttatccgcttga

SEQ ID NO: 1227 - DNA, 21 bp, Artificial Sequence
  Description of Artificial Sequence: Synthetic primer
cggctgacccagtactaacaa

SEQ ID NO: 1228 - DNA, 26 bp, Artificial Sequence
  Description of Artificial Sequence: Synthetic primer
cagcagagtgaataaggataaggtga

SEQ ID NO: 1229 - DNA, 31 bp, Artificial Sequence
  Description of Artificial Sequence: Synthetic primer
ggagtgggttatatttatgtagtgatagagc

SEQ ID NO: 1230 - DNA, 26 bp, Artificial Sequence
  Description of Artificial Sequence: Synthetic primer
cagcagagtgaataaggataaggact

SEQ ID NO: 1231 - DNA, 30 bp, Artificial Sequence
  Description of Artificial Sequence: Synthetic primer
tatttatgaaacgactcattgtaggcatct

SEQ ID NO: 1232 - DNA, 27 bp, Artificial Sequence
  Description of Artificial Sequence: Synthetic primer
ataagacgttgcattattgtcctgaag

SEQ ID NO: 1233 - DNA, 30 bp, Artificial Sequence
  Description of Artificial Sequence: Synthetic primer
tatttatgaaacgactcattgtaggcatca

SEQ ID NO: 1234 - DNA, 23 bp, Artificial Sequence
  Description of Artificial Sequence: Synthetic primer
gtgaaatcattctcgcccagtag

SEQ ID NO: 1235 - DNA, 20 bp, Artificial Sequence
  Description of Artificial Sequence: Synthetic primer
gctgcgtgcgtaatgactac

SEQ ID NO: 1236 - DNA, 23 bp, Artificial Sequence
  Description of Artificial Sequence: Synthetic primer
gtgaaatcattctcgcccagcaa

SEQ ID NO: 1237 - DNA, 23 bp, Artificial Sequence
  Description of Artificial Sequence: Synthetic primer
tgagataaccgtcatagcacagt

SEQ ID NO: 1238 - DNA, 22 bp, Artificial Sequence
  Description of Artificial Sequence: Synthetic primer
cgtttacttttgctcgtcggtt

SEQ ID NO: 1239 - DNA, 23 bp, Artificial Sequence
  Description of Artificial Sequence: Synthetic primer
tgagataaccgtcatagcacagc

SEQ ID NO: 1240 - DNA, 24 bp, Artificial Sequence
  Description of Artificial Sequence: Synthetic primer
gaatagcgttgatgacattgcaag

SEQ ID NO: 1241 - DNA, 25 bp, Artificial Sequence
  Description of Artificial Sequence: Synthetic primer
gatctcattatcgacgacatcaacg

SEQ ID NO: 1242 - DNA, 24 bp, Artificial Sequence
  Description of Artificial Sequence: Synthetic primer
gaataacgtgctactcattgccaa

SEQ ID NO: 1243 - DNA, 24 bp, Artificial Sequence
  Description of Artificial Sequence: Synthetic primer
gtatgctggtgaagatgacgtttc

SEQ ID NO: 1244 - DNA, 20 bp, Artificial Sequence
  Description of Artificial Sequence: Synthetic primer
gtcatcgccgccattttctt

SEQ ID NO: 1245 - DNA, 24 bp, Artificial Sequence
  Description of Artificial Sequence: Synthetic primer
gtatgctggtgaagatgacgttag

SEQ ID NO: 1246 - DNA, 24 bp, Artificial Sequence
  Description of Artificial Sequence: Synthetic primer
gtcttcctgaagtacaacttggac

SEQ ID NO: 1247 - DNA, 18 bp, Artificial Sequence
  Description of Artificial Sequence: Synthetic primer
cagcagcgcacgaccaag

SEQ ID NO: 1248 - DNA, 24 bp, Artificial Sequence
  Description of Artificial Sequence: Synthetic primer
gtttgcctgaagtacaacttggat

SEQ ID NO: 1249 - DNA, 24 bp, Artificial Sequence
  Description of Artificial Sequence: Synthetic primer
acctttatcttcgcgcttatgtca

SEQ ID NO: 1250 - DNA, 26 bp, Artificial Sequence
  Description of Artificial Sequence: Synthetic primer
atccatttaactaagaggacaatgcg

SEQ ID NO: 1251 - DNA, 24 bp, Artificial Sequence
  Description of Artificial Sequence: Synthetic primer
acctttatcttcgcgttaatgagt

SEQ ID NO: 1252 - DNA, 29 bp, Artificial Sequence
  Description of Artificial Sequence: Synthetic primer
tttctccggagtttaaacagttcttttca

SEQ ID NO: 1253 - DNA, 19 bp, Artificial Sequence
  Description of Artificial Sequence: Synthetic primer
ccatgtgagcgcagtttcg

SEQ ID NO: 1254 - DNA, 29 bp, Artificial Sequence
  Description of Artificial Sequence: Synthetic primer
tttctccggagtttaaacagttctttagc

SEQ ID NO: 1255 - DNA, 24 bp, Artificial Sequence
  Description of Artificial Sequence: Synthetic primer
gcatcaaaatcgatcgcactatca

SEQ ID NO: 1256 - DNA, 23 bp, Artificial Sequence
  Description of Artificial Sequence: Synthetic primer
ctttttcacgttcgttagcctgt

SEQ ID NO: 1257 - DNA, 24 bp, Artificial Sequence
  Description of Artificial Sequence: Synthetic primer
gcaagcaaatcgatcgcattaagt

SEQ ID NO: 1258 - DNA, 19 bp, Artificial Sequence
  Description of Artificial Sequence: Synthetic primer
tgacttcgggcatggtagg

SEQ ID NO: 1259 - DNA, 31 bp, Artificial Sequence
  Description of Artificial Sequence: Synthetic primer
aaaatttcgaggttattaatcatgtcagatc

SEQ ID NO: 1260 - DNA, 19 bp, Artificial Sequence
  Description of Artificial Sequence: Synthetic primer
tgacttcgggcatggcaat

SEQ ID NO: 1261 - DNA, 22 bp, Artificial Sequence
  Description of Artificial Sequence: Synthetic primer
gctgtttcgccatgtcaattct

SEQ ID NO: 1262 - DNA, 21 bp, Artificial Sequence
  Description of Artificial Sequence: Synthetic primer
cggattcagacggattgacga

SEQ ID NO: 1263 - DNA, 22 bp, Artificial Sequence
  Description of Artificial Sequence: Synthetic primer
gctgtttcgccatgtcaatagc

SEQ ID NO: 1264 - DNA, 26 bp, Artificial Sequence
  Description of Artificial Sequence: Synthetic primer
tgaagatcttaccccatcacagtttc

SEQ ID NO: 1265 - DNA, 18 bp, Artificial Sequence
  Description of Artificial Sequence: Synthetic primer
ggaacagcccgacacctt

SEQ ID NO: 1266 - DNA, 26 bp, Artificial Sequence
  Description of Artificial Sequence: Synthetic primer
tgaagatttaaccccaagccagtttt

SEQ ID NO: 1267 - DNA, 21 bp, Artificial Sequence
  Description of Artificial Sequence: Synthetic primer
cgtcggctgggtagacattag

SEQ ID NO: 1268 - DNA, 21 bp, Artificial Sequence
  Description of Artificial Sequence: Synthetic primer
tgatgtcagggatttcacgca

SEQ ID NO: 1269 - DNA, 21 bp, Artificial Sequence
  Description of Artificial Sequence: Synthetic primer
cgtcggctgggtagacatcaa

SEQ ID NO: 1270 - DNA, 26 bp, Artificial Sequence
  Description of Artificial Sequence: Synthetic primer
cacgacccccagataaaatattgaag

SEQ ID NO: 1271 - DNA, 23 bp, Artificial Sequence
  Description of Artificial Sequence: Synthetic primer
ccttaaagtcgttgctgtatccg

SEQ ID NO: 1272 - DNA, 26 bp, Artificial Sequence
  Description of Artificial Sequence: Synthetic primer
cagctcccccagataaaatattgcaa

SEQ ID NO: 1273 - DNA, 24 bp, Artificial Sequence
  Description of Artificial Sequence: Synthetic primer
ttatcaacgcggaagagattgact

SEQ ID NO: 1274 - DNA, 22 bp, Artificial Sequence
  Description of Artificial Sequence: Synthetic primer
atgacttcaatgcccagttcct

SEQ ID NO: 1275 - DNA, 24 bp, Artificial Sequence
  Description of Artificial Sequence: Synthetic primer
ttatcaacgcggaagagattgaca

SEQ ID NO: 1276 - DNA, 27 bp, Artificial Sequence
  Description of Artificial Sequence: Synthetic primer
gcgctaaaactacaagaagatgaatca

SEQ ID NO: 1277 - DNA, 27 bp, Artificial Sequence
  Description of Artificial Sequence: Synthetic primer
aaggtgcttttttacgcatttttaaca

SEQ ID NO: 1278 - DNA, 27 bp, Artificial Sequence
  Description of Artificial Sequence: Synthetic primer
gcgttgaaactacaagaagatgaaagc

SEQ ID NO: 1279 - DNA, 29 bp, Artificial Sequence
  Description of Artificial Sequence: Synthetic primer
gtattgcctattgtttgttctagtgtgga

SEQ ID NO: 1280 - DNA, 25 bp, Artificial Sequence
  Description of Artificial Sequence: Synthetic primer
tgaagaactaaaattcacctccgtt

SEQ ID NO: 1281 - DNA, 29 bp, Artificial Sequence
  Description of Artificial Sequence: Synthetic primer
gtattgcctattgtttgttctaatgtact

SEQ ID NO: 1282 - DNA, 21 bp, Artificial Sequence
  Description of Artificial Sequence: Synthetic primer
aacaatcgccgctttcgtaag

SEQ ID NO: 1283 - DNA, 24 bp, Artificial Sequence
  Description of Artificial Sequence: Synthetic primer
acaacgcctgaaatgatgcataaa

SEQ ID NO: 1284 - DNA, 21 bp, Artificial Sequence
  Description of Artificial Sequence: Synthetic primer
aacaatcgccgctttcgttaa

SEQ ID NO: 1285 - DNA, 23 bp, Artificial Sequence
  Description of Artificial Sequence: Synthetic primer
tacctcagcgacaagaaaaagcg

SEQ ID NO: 1286 - DNA, 19 bp, Artificial Sequence
  Description of Artificial Sequence: Synthetic primer
ttcggctttgagtgtccgt

SEQ ID NO: 1287 - DNA, 23 bp, Artificial Sequence
  Description of Artificial Sequence: Synthetic primer
tacctcagcgaccaaaaacaaac

SEQ ID NO: 1288 - DNA, 20 bp, Artificial Sequence
  Description of Artificial Sequence: Synthetic primer
gcagaaatcagaccgagtga

SEQ ID NO: 1289 - DNA, 24 bp, Artificial Sequence
  Description of Artificial Sequence: Synthetic primer
gttatggtcgcgtgaagattgaag

SEQ ID NO: 1290 - DNA, 20 bp, Artificial Sequence
  Description of Artificial Sequence: Synthetic primer
gcagaaatcagaccgaggct

SEQ ID NO: 1291 - DNA, 29 bp, Artificial Sequence
  Description of Artificial Sequence: Synthetic primer
gttgttcatattcagtactttaccgactg

SEQ ID NO: 1292 - DNA, 20 bp, Artificial Sequence
  Description of Artificial Sequence: Synthetic primer
cgctggggctgaaattcatc

SEQ ID NO: 1293 - DNA, 29 bp, Artificial Sequence
  Description of Artificial Sequence: Synthetic primer
gttgttcatattcagtactttaccgacgc

SEQ ID NO: 1294 - DNA, 24 bp, Artificial Sequence
  Description of Artificial Sequence: Synthetic primer
caaccgtaattaacaacgccatct

SEQ ID NO: 1295 - DNA, 27 bp, Artificial Sequence
  Description of Artificial Sequence: Synthetic primer
aatcagacgtttattggtgtgtttacg

SEQ ID NO: 1296 - DNA, 24 bp, Artificial Sequence
  Description of Artificial Sequence: Synthetic primer
caaccgtaattaacaacgccatca

SEQ ID NO: 1297 - DNA, 20 bp, Artificial Sequence
  Description of Artificial Sequence: Synthetic primer
ccgaacaaatcctcgccctt

SEQ ID NO: 1298 - DNA, 22 bp, Artificial Sequence
  Description of Artificial Sequence: Synthetic primer
gaacagacgaatgccttcagac

SEQ ID NO: 1299 - DNA, 20 bp, Artificial Sequence
  Description of Artificial Sequence: Synthetic primer
ccgaacaaatcctcgcctta

SEQ ID NO: 1300 - DNA, 22 bp, Artificial Sequence
  Description of Artificial Sequence: Synthetic primer
cgatgtgcattgagttgtggtg

SEQ ID NO: 1301 - DNA, 25 bp, Artificial Sequence
  Description of Artificial Sequence: Synthetic primer
ctttttttacattgtgctgctgtcg

SEQ ID NO: 1302 - DNA, 22 bp, Artificial Sequence
  Description of Artificial Sequence: Synthetic primer
cgatgtgcattgagttgtggac

SEQ ID NO: 1303 - DNA, 28 bp, Artificial Sequence
  Description of Artificial Sequence: Synthetic primer
ttacacctcatggaaaaattgctgatat

SEQ ID NO: 1304 - DNA, 31 bp, Artificial Sequence
  Description of Artificial Sequence: Synthetic primer
aacctctcttataattatgggtattctacgg

SEQ ID NO: 1305 - DNA, 28 bp, Artificial Sequence
  Description of Artificial Sequence: Synthetic primer
ctacacctcatggaaaaattgctgataa

SEQ ID NO: 1306 - DNA, 21 bp, Artificial Sequence
  Description of Artificial Sequence: Synthetic primer
gtcaaaaaccagtgcctcaga

SEQ ID NO: 1307 - DNA, 21 bp, Artificial Sequence
  Description of Artificial Sequence: Synthetic primer
ccgcattttgtccagcatctc

SEQ ID NO: 1308 - DNA, 21 bp, Artificial Sequence
  Description of Artificial Sequence: Synthetic primer
gtcaaaaaccagtgcctcgct

SEQ ID NO: 1309 - DNA, 21 bp, Artificial Sequence
  Description of Artificial Sequence: Synthetic primer
tatcttcggtgccagccatga

SEQ ID NO: 1310 - DNA, 18 bp, Artificial Sequence
  Description of Artificial Sequence: Synthetic primer
cggtctgtcactgcacga

SEQ ID NO: 1311 - DNA, 21 bp, Artificial Sequence
  Description of Artificial Sequence: Synthetic primer
tatcttcggtgccagccaact

SEQ ID NO: 1312 - DNA, 21 bp, Artificial Sequence
  Description of Artificial Sequence: Synthetic primer
cagcagcagtgtgatccctag

SEQ ID NO: 1313 - DNA, 22 bp, Artificial Sequence
  Description of Artificial Sequence: Synthetic primer
cggtagcgctaggtcattttct

SEQ ID NO: 1314 - DNA, 21 bp, Artificial Sequence
  Description of Artificial Sequence: Synthetic primer
cagcagcagtgtgatccctaa

SEQ ID NO: 1315 - DNA, 24 bp, Artificial Sequence
  Description of Artificial Sequence: Synthetic primer
agattggcggtaataaaatgcgat

SEQ ID NO: 1316 - DNA, 20 bp, Artificial Sequence
  Description of Artificial Sequence: Synthetic primer
ggagtcgcggttctacactg

SEQ ID NO: 1317 - DNA, 24 bp, Artificial Sequence
  Description of Artificial Sequence: Synthetic primer
agattggcggtaataaaatggctg

SEQ ID NO: 1318 - DNA, 21 bp, Artificial Sequence
  Description of Artificial Sequence: Synthetic primer
ctgacgacgaaacctttgcat

SEQ ID NO: 1319 - DNA, 23 bp, Artificial Sequence
  Description of Artificial Sequence: Synthetic primer
gtcgatacagaccagcgatagat

SEQ ID NO: 1320 - DNA, 21 bp, Artificial Sequence
  Description of Artificial Sequence: Synthetic primer
ctgacgacgaaacctttgcaa

SEQ ID NO: 1321 - DNA, 24 bp, Artificial Sequence
  Description of Artificial Sequence: Synthetic primer
ctgttcctgattaaaacccggaag

SEQ ID NO: 1322 - DNA, 24 bp, Artificial Sequence
  Description of Artificial Sequence: Synthetic primer
accagtatcacatcgactcagaac

SEQ ID NO: 1323 - DNA, 24 bp, Artificial Sequence
  Description of Artificial Sequence: Synthetic primer
ctgttcctgattaaaacccggcaa

SEQ ID NO: 1324 - DNA, 28 bp, Artificial Sequence
  Description of Artificial Sequence: Synthetic primer
gggttctatggtgaatgataaaaccctt

SEQ ID NO: 1325 - DNA, 24 bp, Artificial Sequence
  Description of Artificial Sequence: Synthetic primer
caggacatttggtatttggctgaa

SEQ ID NO: 1326 - DNA, 28 bp, Artificial Sequence
  Description of Artificial Sequence: Synthetic primer
gggttctatggtgaatgataaaacctta

SEQ ID NO: 1327 - DNA, 25 bp, Artificial Sequence
  Description of Artificial Sequence: Synthetic primer
taatccagtgcagataaccttcaga

SEQ ID NO: 1328 - DNA, 21 bp, Artificial Sequence
  Description of Artificial Sequence: Synthetic primer
agagcctgcacttctttctgg

SEQ ID NO: 1329 - DNA, 25 bp, Artificial Sequence
  Description of Artificial Sequence: Synthetic primer
taatccagtgcagataaccttcact

SEQ ID NO: 1330 - DNA, 25 bp, Artificial Sequence
  Description of Artificial Sequence: Synthetic primer
cactgatgctaccggtaaaaaactt

SEQ ID NO: 1331 - DNA, 19 bp, Artificial Sequence
  Description of Artificial Sequence: Synthetic primer
cgcacagtcaaccaccatg

SEQ ID NO: 1332 - DNA, 25 bp, Artificial Sequence
  Description of Artificial Sequence: Synthetic primer
cactgatgctaccggtaaaaaattg

SEQ ID NO: 1333 - DNA, 20 bp, Artificial Sequence
  Description of Artificial Sequence: Synthetic primer
cggcagatgacttcggttca

SEQ ID NO: 1334 - DNA, 26 bp, Artificial Sequence
  Description of Artificial Sequence: Synthetic primer
tctttgatataacgtgcgatgttcag

SEQ ID NO: 1335 - DNA, 20 bp, Artificial Sequence
  Description of Artificial Sequence: Synthetic primer
cggcagatgacttcggtagc

SEQ ID NO: 1336 - DNA, 19 bp, Artificial Sequence
  Description of Artificial Sequence: Synthetic primer
cgtggcgatgcgtgaactt

SEQ ID NO: 1337 - DNA, 25 bp, Artificial Sequence
  Description of Artificial Sequence: Synthetic primer
catccagttcatcggtcgtttttag

SEQ ID NO: 1338 - DNA, 19 bp, Artificial Sequence
  Description of Artificial Sequence: Synthetic primer
cgtggcgatgcgtgaatta

SEQ ID NO: 1339 - DNA, 23 bp, Artificial Sequence
  Description of Artificial Sequence: Synthetic primer
cgaccgatggatttacgaacaag

SEQ ID NO: 1340 - DNA, 20 bp, Artificial Sequence
  Description of Artificial Sequence: Synthetic primer
gtctgtggaacggcatcaaa

SEQ ID NO: 1341 - DNA, 23 bp, Artificial Sequence
  Description of Artificial Sequence: Synthetic primer
cgaccgatggatttacgaactaa

SEQ ID NO: 1342 - DNA, 21 bp, Artificial Sequence
  Description of Artificial Sequence: Synthetic primer
gaacatgcgtgacgagctatc

SEQ ID NO: 1343 - DNA, 22 bp, Artificial Sequence
  Description of Artificial Sequence: Synthetic primer
cggcactagataaacgcagaag

SEQ ID NO: 1344 - DNA, 21 bp, Artificial Sequence
  Description of Artificial Sequence: Synthetic primer
gaacatgcgtgacgagttaag

SEQ ID NO: 1345 - DNA, 21 bp, Artificial Sequence
  Description of Artificial Sequence: Synthetic primer
tcagcgttgatcatcacacca

SEQ ID NO: 1346 - DNA, 18 bp, Artificial Sequence
  Description of Artificial Sequence: Synthetic primer
gtcggcccgtgtggtatg

SEQ ID NO: 1347 - DNA, 21 bp, Artificial Sequence
  Description of Artificial Sequence: Synthetic primer
tcagcgttgatcatcacaccg

SEQ ID NO: 1348 - DNA, 29 bp, Artificial Sequence
  Description of Artificial Sequence: Synthetic primer
gtgttgatgatagatatagtggacatctg

SEQ ID NO: 1349 - DNA, 28 bp, Artificial Sequence
  Description of Artificial Sequence: Synthetic primer
gttaatgagggatttatgaaaacgatgc

SEQ ID NO: 1350 - DNA, 29 bp, Artificial Sequence
  Description of Artificial Sequence: Synthetic primer
gtgttgatgatagatatagtggacatcgc

SEQ ID NO: 1351 - DNA, 23 bp, Artificial Sequence
  Description of Artificial Sequence: Synthetic primer
ccaaattctgagtgtccccatga

SEQ ID NO: 1352 - DNA, 18 bp, Artificial Sequence
  Description of Artificial Sequence: Synthetic primer
gcggtgtggctggaaaac

SEQ ID NO: 1353 - DNA, 23 bp, Artificial Sequence
  Description of Artificial Sequence: Synthetic primer
ccaaattcactgtgtccccaact

SEQ ID NO: 1354 - DNA, 19 bp, Artificial Sequence
  Description of Artificial Sequence: Synthetic primer
gggcgttctctgggcaatt

SEQ ID NO: 1355 - DNA, 19 bp, Artificial Sequence
  Description of Artificial Sequence: Synthetic primer
aagatcatggcgcgttcct

SEQ ID NO: 1356 - DNA, 19 bp, Artificial Sequence
  Description of Artificial Sequence: Synthetic primer
gggcgttctctgggcaata

SEQ ID NO: 1357 - DNA, 24 bp, Artificial Sequence
  Description of Artificial Sequence: Synthetic primer
cgcacccagttcttcgttaaatag

SEQ ID NO: 1358 - DNA, 22 bp, Artificial Sequence
  Description of Artificial Sequence: Synthetic primer
gcctgtatgaagccgttaaagc

SEQ ID NO: 1359 - DNA, 24 bp, Artificial Sequence
  Description of Artificial Sequence: Synthetic primer
cgcacccagttcttcgttaaacaa

SEQ ID NO: 1360 - DNA, 18 bp, Artificial Sequence
  Description of Artificial Sequence: Synthetic primer
caggggcttgcccagtca

SEQ ID NO: 1361 - DNA, 18 bp, Artificial Sequence
  Description of Artificial Sequence: Synthetic primer
gttttgcgccaccagacc

SEQ ID NO: 1362 - DNA, 18 bp, Artificial Sequence
  Description of Artificial Sequence: Synthetic primer
caggggcttgcccagagt

SEQ ID NO: 1363 - DNA, 18 bp, Artificial Sequence
  Description of Artificial Sequence: Synthetic primer
cgacaaccgcgacaactc

SEQ ID NO: 1364 - DNA, 18 bp, Artificial Sequence
  Description of Artificial Sequence: Synthetic primer
gggaccaacgctgtttcg

SEQ ID NO: 1365 - DNA, 18 bp, Artificial Sequence
  Description of Artificial Sequence: Synthetic primer
cgacaaccgcgacaacag

SEQ ID NO: 1366 - DNA, 19 bp, Artificial Sequence
  Description of Artificial Sequence: Synthetic primer
ggtccgttagctgctctga

SEQ ID NO: 1367 - DNA, 27 bp, Artificial Sequence
  Description of Artificial Sequence: Synthetic primer
gaggattaggtggtgaaataaaaaggc

SEQ ID NO: 1368 - DNA, 19 bp, Artificial Sequence
  Description of Artificial Sequence: Synthetic primer
ggtccgttaactgctcgct

SEQ ID NO: 1369 - DNA, 21 bp, Artificial Sequence
  Description of Artificial Sequence: Synthetic primer
gcagcggtacaccttctttca

SEQ ID NO: 1370 - DNA, 19 bp, Artificial Sequence
  Description of Artificial Sequence: Synthetic primer
acccatgatagcgcctgtg

SEQ ID NO: 1371 - DNA, 21 bp, Artificial Sequence
  Description of Artificial Sequence: Synthetic primer
gcagcggtacaccttttgagt

SEQ ID NO: 1372 - DNA, 24 bp, Artificial Sequence
  Description of Artificial Sequence: Synthetic primer
tctgcggtattggaagtcagattc

SEQ ID NO: 1373 - DNA, 19 bp, Artificial Sequence
  Description of Artificial Sequence: Synthetic primer
gaggcacgacgtcttttct

SEQ ID NO: 1374 - DNA, 24 bp, Artificial Sequence
  Description of Artificial Sequence: Synthetic primer
tctgcggtattggaagtcagattg

SEQ ID NO: 1375 - DNA, 28 bp, Artificial Sequence
  Description of Artificial Sequence: Synthetic primer
gtttggactaatgttctctgtctcacta

SEQ ID NO: 1376 - DNA, 21 bp, Artificial Sequence
  Description of Artificial Sequence: Synthetic primer
caatcgccgtgcattcatcat

SEQ ID NO: 1377 - DNA, 28 bp, Artificial Sequence
  Description of Artificial Sequence: Synthetic primer
gtttggattgatgttctctgtcagtttg

SEQ ID NO: 1378 - DNA, 18 bp, Artificial Sequence
  Description of Artificial Sequence: Synthetic primer
gaccatcgcctcgtctga

SEQ ID NO: 1379 - DNA, 22 bp, Artificial Sequence
  Description of Artificial Sequence: Synthetic primer
ggaacaacaggcgcttatgaaa

SEQ ID NO: 1380 - DNA, 18 bp, Artificial Sequence
  Description of Artificial Sequence: Synthetic primer
gaccatcgcctcgtcgct

SEQ ID NO: 1381 - DNA, 26 bp, Artificial Sequence
  Description of Artificial Sequence: Synthetic primer
cgctaactatcgaccattgtctacta

SEQ ID NO: 1382 - DNA, 25 bp, Artificial Sequence
  Description of Artificial Sequence: Synthetic primer
ctttttgcatttccgctgattcaag

SEQ ID NO: 1383 - DNA, 26 bp, Artificial Sequence
  Description of Artificial Sequence: Synthetic primer
cgttaactatcgaccattgtttgttg

SEQ ID NO: 1384 - DNA, 24 bp, Artificial Sequence
  Description of Artificial Sequence: Synthetic primer
accgataactatggtgaagactcc

SEQ ID NO: 1385 - DNA, 21 bp, Artificial Sequence
  Description of Artificial Sequence: Synthetic primer
ttccagactcactctccggta

SEQ ID NO: 1386 - DNA, 24 bp, Artificial Sequence
  Description of Artificial Sequence: Synthetic primer
accgataactatggtgaagacagt

SEQ ID NO: 1387 - DNA, 27 bp, Artificial Sequence
  Description of Artificial Sequence: Synthetic primer
ctcaggcgttttctgttcttttgatga

SEQ ID NO: 1388 - DNA, 24 bp, Artificial Sequence
  Description of Artificial Sequence: Synthetic primer
tgccagttttcacattcttcagtt

SEQ ID NO: 1389 - DNA, 27 bp, Artificial Sequence
  Description of Artificial Sequence: Synthetic primer
ctcaggcgttttctgttctttactact

SEQ ID NO: 1390 - DNA, 22 bp, Artificial Sequence
  Description of Artificial Sequence: Synthetic primer
cgaactaattggcatggactct

SEQ ID NO: 1391 - DNA, 21 bp, Artificial Sequence
  Description of Artificial Sequence: Synthetic primer
tttcttgtgagtcggcctgat

SEQ ID NO: 1392 - DNA, 22 bp, Artificial Sequence
  Description of Artificial Sequence: Synthetic primer
cgaattgattggcatggacagc

SEQ ID NO: 1393 - DNA, 21 bp, Artificial Sequence
  Description of Artificial Sequence: Synthetic primer
ccagcctttatgcagcgtctt

SEQ ID NO: 1394 - DNA, 20 bp, Artificial Sequence
  Description of Artificial Sequence: Synthetic primer
cgacggcatccattacttcc

SEQ ID NO: 1395 - DNA, 21 bp, Artificial Sequence
  Description of Artificial Sequence: Synthetic primer
ccagcctttatgcagcgttta

SEQ ID NO: 1396 - DNA, 26 bp, Artificial Sequence
  Description of Artificial Sequence: Synthetic primer
ggaagttttacacctcatatacgctt

SEQ ID NO: 1397 - DNA, 18 bp, Artificial Sequence
  Description of Artificial Sequence: Synthetic primer
aggaatgttggcgtggct

SEQ ID NO: 1398 - DNA, 26 bp, Artificial Sequence
  Description of Artificial Sequence: Synthetic primer
ggaagttttacaccagctatacgttg

SEQ ID NO: 1399 - DNA, 19 bp, Artificial Sequence
  Description of Artificial Sequence: Synthetic primer
cccggcttcagttcgttag

SEQ ID NO: 1400 - DNA, 27 bp, Artificial Sequence
  Description of Artificial Sequence: Synthetic primer
cccattcattaagtaactctgcacttg

SEQ ID NO: 1401 - DNA, 19 bp, Artificial Sequence
  Description of Artificial Sequence: Synthetic primer
cccggcttcagttcgttac

SEQ ID NO: 1402 - DNA, 21 bp, Artificial Sequence
  Description of Artificial Sequence: Synthetic primer
gtgtaaccgtagacctcctga

SEQ ID NO: 1403 - DNA, 18 bp, Artificial Sequence
  Description of Artificial Sequence: Synthetic primer
gtgggcgtgtggtgtctc

SEQ ID NO: 1404 - DNA, 21 bp, Artificial Sequence
  Description of Artificial Sequence: Synthetic primer
gtgtaaccgtagacctcctgc

SEQ ID NO: 1405 - DNA, 23 bp, Artificial Sequence
  Description of Artificial Sequence: Synthetic primer
aactgattggtatggtcgctcaa

SEQ ID NO: 1406 - DNA, 21 bp, Artificial Sequence
  Description of Artificial Sequence: Synthetic primer
gctggtagatctcttcacggt

SEQ ID NO: 1407 - DNA, 23 bp, Artificial Sequence
  Description of Artificial Sequence: Synthetic primer
aactgattggtatggtcgctcag

SEQ ID NO: 1408 - DNA, 21 bp, Artificial Sequence
  Description of Artificial Sequence: Synthetic primer
ctgcccaacctgttcggaaag

SEQ ID NO: 1409 - DNA, 28 bp, Artificial Sequence
  Description of Artificial Sequence: Synthetic primer
caaaactaagtactctatttcgcagctt

SEQ ID NO: 1410 - DNA, 21 bp, Artificial Sequence
  Description of Artificial Sequence: Synthetic primer
ctgcccaacctgttcacttaa

SEQ ID NO: 1411 - DNA, 19 bp, Artificial Sequence
  Description of Artificial Sequence: Synthetic primer
gcatcgcatccatcactga

SEQ ID NO: 1412 - DNA, 24 bp, Artificial Sequence
  Description of Artificial Sequence: Synthetic primer
gaagataaatctatcgcgctgctg

SEQ ID NO: 1413 - DNA, 19 bp, Artificial Sequence
  Description of Artificial Sequence: Synthetic primer
gcatcgcatccatcacgct

SEQ ID NO: 1414 - DNA, 21 bp, Artificial Sequence
  Description of Artificial Sequence: Synthetic primer
aagcaccattatcggctgtga

SEQ ID NO: 1415 - DNA, 20 bp, Artificial Sequence
  Description of Artificial Sequence: Synthetic primer
gtcggcgaagtcaactcaga

SEQ ID NO: 1416 - DNA, 21 bp, Artificial Sequence
  Description of Artificial Sequence: Synthetic primer
aagcaccattatcggctgact

SEQ ID NO: 1417 - DNA, 22 bp, Artificial Sequence
  Description of Artificial Sequence: Synthetic primer
cgaggtcagtttcaaccgtaag

SEQ ID NO: 1418 - DNA, 23 bp, Artificial Sequence
  Description of Artificial Sequence: Synthetic primer
cgtaaaaactcgccgctgaaata

SEQ ID NO: 1419 - DNA, 22 bp, Artificial Sequence
  Description of Artificial Sequence: Synthetic primer
cgaggtcagtttcaaccgttaa

SEQ ID NO: 1420 - DNA, 27 bp, Artificial Sequence
  Description of Artificial Sequence: Synthetic primer
ctattgaaaacaatgtgccggtgaatc

SEQ ID NO: 1421 - DNA, 27 bp, Artificial Sequence
  Description of Artificial Sequence: Synthetic primer
cattcctcaggtgattgtcatttttga

SEQ ID NO: 1422 - DNA, 27 bp, Artificial Sequence
  Description of Artificial Sequence: Synthetic primer
ctattgaaaacaatgtgccggtgaatt

SEQ ID NO: 1423 - DNA, 21 bp, Artificial Sequence
  Description of Artificial Sequence: Synthetic primer
attacgcttatcccgacgctt

SEQ ID NO: 1424 - DNA, 20 bp, Artificial Sequence
  Description of Artificial Sequence: Synthetic primer
agacgtgcctgatcttcctg

SEQ ID NO: 1425 - DNA, 21 bp, Artificial Sequence
  Description of Artificial Sequence: Synthetic primer
attacgcttatcccgacgttg

SEQ ID NO: 1426 - DNA, 23 bp, Artificial Sequence
  Description of Artificial Sequence: Synthetic primer
cccgcatccagatagatacaaga

SEQ ID NO: 1427 - DNA, 21 bp, Artificial Sequence
  Description of Artificial Sequence: Synthetic primer
gcaggcatttgagttcaggtc

SEQ ID NO: 1428 - DNA, 23 bp, Artificial Sequence
  Description of Artificial Sequence: Synthetic primer
cccgcatccagatagatacaact

SEQ ID NO: 1429 - DNA, 20 bp, Artificial Sequence
  Description of Artificial Sequence: Synthetic primer
gtttgcaggatttcgcgtag

SEQ ID NO: 1430 - DNA, 21 bp, Artificial Sequence
  Description of Artificial Sequence: Synthetic primer
ctcaacatacgcaacctggtg

SEQ ID NO: 1431 - DNA, 20 bp, Artificial Sequence
  Description of Artificial Sequence: Synthetic primer
gtttgcaggatttcgcgcaa

SEQ ID NO: 1432 - DNA, 22 bp, Artificial Sequence
  Description of Artificial Sequence: Synthetic primer
agaggaagttgtgcaaaacgtg

SEQ ID NO: 1433 - DNA, 21 bp, Artificial Sequence
  Description of Artificial Sequence: Synthetic primer
agcaagctacaaacgcgaaac

SEQ ID NO: 1434 - DNA, 22 bp, Artificial Sequence
  Description of Artificial Sequence: Synthetic primer
agaggaagttgtgcaaaacggc

SEQ ID NO: 1435 - DNA, 22 bp, Artificial Sequence
  Description of Artificial Sequence: Synthetic primer
gcagacgaccaatcagagttga

SEQ ID NO: 1436 - DNA, 19 bp, Artificial Sequence
  Description of Artificial Sequence: Synthetic primer
cggatggtgcgtttccgta

SEQ ID NO: 1437 - DNA, 22 bp, Artificial Sequence
  Description of Artificial Sequence: Synthetic primer
gcagacgaccaatcagagtact

SEQ ID NO: 1438 - DNA, 25 bp, Artificial Sequence
  Description of Artificial Sequence: Synthetic primer
caaggactgtatggtaatcacgaag

SEQ ID NO: 1439 - DNA, 26 bp, Artificial Sequence
  Description of Artificial Sequence: Synthetic primer
cgtgaacatgcgatcttatcttatcc

SEQ ID NO: 1440 - DNA, 25 bp, Artificial Sequence
  Description of Artificial Sequence: Synthetic primer
caaggactgtatggtaatcacgcaa

SEQ ID NO: 1441 - DNA, 28 bp, Artificial Sequence
  Description of Artificial Sequence: Synthetic primer
atcgcttatttgatacaagtcctgaaag

SEQ ID NO: 1442 - DNA, 21 bp, Artificial Sequence
  Description of Artificial Sequence: Synthetic primer
gcggggctttctataaacgat

SEQ ID NO: 1443 - DNA, 28 bp, Artificial Sequence
  Description of Artificial Sequence: Synthetic primer
atcgcttatttgatacaagtccactcaa

SEQ ID NO: 1444 - DNA, 19 bp, Artificial Sequence
  Description of Artificial Sequence: Synthetic primer
ccagttgctccgggttaag

SEQ ID NO: 1445 - DNA, 25 bp, Artificial Sequence
  Description of Artificial Sequence: Synthetic primer
tatcgctatcccgtctttaatccac

SEQ ID NO: 1446 - DNA, 19 bp, Artificial Sequence
  Description of Artificial Sequence: Synthetic primer
ccagttgctccgggttcaa

SEQ ID NO: 1447 - DNA, 31 bp, Artificial Sequence
  Description of Artificial Sequence: Synthetic primer
aaagtgaacagatattaataattttgcctga

SEQ ID NO: 1448 - DNA, 26 bp, Artificial Sequence
  Description of Artificial Sequence: Synthetic primer
tttcaggtggattacttttctcaggt

SEQ ID NO: 1449 - DNA, 31 bp, Artificial Sequence
  Description of Artificial Sequence: Synthetic primer
acaatgaacagatattaataattttgccgct

SEQ ID NO: 1450 - DNA, 25 bp, Artificial Sequence
  Description of Artificial Sequence: Synthetic primer
gattatgatcggctttgattcctca

SEQ ID NO: 1451 - DNA, 31 bp, Artificial Sequence
  Description of Artificial Sequence: Synthetic primer
agttaaagtttttattatgttccctgcatca

SEQ ID NO: 1452 - DNA, 25 bp, Artificial Sequence
  Description of Artificial Sequence: Synthetic primer
gattatgatcggctttgattccagc

SEQ ID NO: 1453 - DNA, 21 bp, Artificial Sequence
  Description of Artificial Sequence: Synthetic primer
gcgtggtagctaatgatcgtt

SEQ ID NO: 1454 - DNA, 22 bp, Artificial Sequence
  Description of Artificial Sequence: Synthetic primer
gctctccccagtcgatattctc

SEQ ID NO: 1455 - DNA, 21 bp, Artificial Sequence
  Description of Artificial Sequence: Synthetic primer
gcgtggtagctaatgatcgta

SEQ ID NO: 1456 - DNA, 24 bp, Artificial Sequence
  Description of Artificial Sequence: Synthetic primer
gcaatgcacgctggatattctttc

SEQ ID NO: 1457 - DNA, 24 bp, Artificial Sequence
  Description of Artificial Sequence: Synthetic primer
catgttgcaccatatcttccagga

SEQ ID NO: 1458 - DNA, 24 bp, Artificial Sequence
  Description of Artificial Sequence: Synthetic primer
gcaatgcacgctggatattttaag

SEQ ID NO: 1459 - DNA, 20 bp, Artificial Sequence
  Description of Artificial Sequence: Synthetic primer
gcaaacagttcgatgcccta

SEQ ID NO: 1460 - DNA, 26 bp, Artificial Sequence
  Description of Artificial Sequence: Synthetic primer
aaaacaagaacaagaaaggaagggtt

SEQ ID NO: 1461 - DNA, 20 bp, Artificial Sequence
  Description of Artificial Sequence: Synthetic primer
gcaaacagttcgatgccttg

SEQ ID NO: 1462 - DNA, 29 bp, Artificial Sequence
  Description of Artificial Sequence: Synthetic primer
taagtgaagagagaaattagtggacgatc

SEQ ID NO: 1463 - DNA, 28 bp, Artificial Sequence
  Description of Artificial Sequence: Synthetic primer
gtcgtataaaaggtatgaattgtgggtt

SEQ ID NO: 1464 - DNA, 29 bp, Artificial Sequence
  Description of Artificial Sequence: Synthetic primer
taagtgaagagagaaattagtggacgatt

SEQ ID NO: 1465 - DNA, 24 bp, Artificial Sequence
  Description of Artificial Sequence: Synthetic primer
gtttccatatggcagcctatcaat

SEQ ID NO: 1466 - DNA, 24 bp, Artificial Sequence
  Description of Artificial Sequence: Synthetic primer
agttgccttacgatttttgagagc

SEQ ID NO: 1467 - DNA, 24 bp, Artificial Sequence
  Description of Artificial Sequence: Synthetic primer
gtttccatatggcagcctatcaaa

SEQ ID NO: 1468 - DNA, 22 bp, Artificial Sequence
  Description of Artificial Sequence: Synthetic primer
ccatctctgccagcacttttag

SEQ ID NO: 1469 - DNA, 20 bp, Artificial Sequence
  Description of Artificial Sequence: Synthetic primer
ttcggttggtatggcgtagg

SEQ ID NO: 1470 - DNA, 22 bp, Artificial Sequence
  Description of Artificial Sequence: Synthetic primer
ccatctctgccagcactttcaa

SEQ ID NO: 1471 - DNA, 19 bp, Artificial Sequence
  Description of Artificial Sequence: Synthetic primer
cttccgccagcgttgctag

SEQ ID NO: 1472 - DNA, 19 bp, Artificial Sequence
  Description of Artificial Sequence: Synthetic primer
cgagagaaagtggcgcaac

SEQ ID NO: 1473 - DNA, 19 bp, Artificial Sequence
  Description of Artificial Sequence: Synthetic primer
cttccgccagcgttgctaa

SEQ ID NO: 1474 - DNA, 26 bp, Artificial Sequence
  Description of Artificial Sequence: Synthetic primer
ttaatgatatcgggctactacactca

SEQ ID NO: 1475 - DNA, 19 bp, Artificial Sequence
  Description of Artificial Sequence: Synthetic primer
gaagaaagcgcaccgtacc

SEQ ID NO: 1476 - DNA, 26 bp, Artificial Sequence
  Description of Artificial Sequence: Synthetic primer
ttaatgatatcgggttgttgcacagc

SEQ ID NO: 1477 - DNA, 26 bp, Artificial Sequence
  Description of Artificial Sequence: Synthetic primer
cgtgatagcatgtcatcaaaaccaag

SEQ ID NO: 1478 - DNA, 23 bp, Artificial Sequence
  Description of Artificial Sequence: Synthetic primer
ggtcgtctttgaaacctggaaag

SEQ ID NO: 1479 - DNA, 26 bp, Artificial Sequence
  Description of Artificial Sequence: Synthetic primer
cgacttaacatgtcatcaaaacccaa

SEQ ID NO: 1480 - DNA, 22 bp, Artificial Sequence
  Description of Artificial Sequence: Synthetic primer
gctatggcgatctcatctgtac

SEQ ID NO: 1481 - DNA, 22 bp, Artificial Sequence
  Description of Artificial Sequence: Synthetic primer
catcctgacgtacgacctgaaa

SEQ ID NO: 1482 - DNA, 22 bp, Artificial Sequence
  Description of Artificial Sequence: Synthetic primer
gctatggcgatcagtagcgtat

SEQ ID NO: 1483 - DNA, 26 bp, Artificial Sequence
  Description of Artificial Sequence: Synthetic primer
cgcgaaagtcctacttcttcaaatag

SEQ ID NO: 1484 - DNA, 24 bp, Artificial Sequence
  Description of Artificial Sequence: Synthetic primer
atccaccccttcctctgtttataa

SEQ ID NO: 1485 - DNA, 26 bp, Artificial Sequence
  Description of Artificial Sequence: Synthetic primer
cggcttaatcctacttcttcaaacaa

SEQ ID NO: 1486 - DNA, 24 bp, Artificial Sequence
  Description of Artificial Sequence: Synthetic primer
cttattatcgcctccaaagtgtca

SEQ ID NO: 1487 - DNA, 18 bp, Artificial Sequence
  Description of Artificial Sequence: Synthetic primer
cgcgttggtactctgcca

SEQ ID NO: 1488 - DNA, 24 bp, Artificial Sequence
  Description of Artificial Sequence: Synthetic primer
ttaattatcgcctccaaagtgagc

SEQ ID NO: 1489 - DNA, 18 bp, Artificial Sequence
  Description of Artificial Sequence: Synthetic primer
ggcgaaccagacgaatcg

SEQ ID NO: 1490 - DNA, 18 bp, Artificial Sequence
  Description of Artificial Sequence: Synthetic primer
ggtaacgcacggtggtca

SEQ ID NO: 1491 - DNA, 18 bp, Artificial Sequence
  Description of Artificial Sequence: Synthetic primer
ggcgaaccagacgaaagc

SEQ ID NO: 1492 - DNA, 24 bp, Artificial Sequence
  Description of Artificial Sequence: Synthetic primer
tgcctgagacatgaagaatactga

SEQ ID NO: 1493 - DNA, 24 bp, Artificial Sequence
  Description of Artificial Sequence: Synthetic primer
tctgcgaaagattgatggtattcc

SEQ ID NO: 1494 - DNA, 24 bp, Artificial Sequence
  Description of Artificial Sequence: Synthetic primer
tgcctgagacatgaagaatacgct

SEQ ID NO: 1495 - DNA, 24 bp, Artificial Sequence
  Description of Artificial Sequence: Synthetic primer
gaatatgcgcctatgacaaatgct

SEQ ID NO: 1496 - DNA, 24 bp, Artificial Sequence
  Description of Artificial Sequence: Synthetic primer
atcacacgagaagttcagaagcat

SEQ ID NO: 1497 - DNA, 24 bp, Artificial Sequence
  Description of Artificial Sequence: Synthetic primer
gaatatgcgcctatgacaaatgcg

SEQ ID NO: 1498 - DNA, 31 bp, Artificial Sequence
  Description of Artificial Sequence: Synthetic primer
tccaatcggtatcaataatctatctcaatca

SEQ ID NO: 1499 - DNA, 29 bp, Artificial Sequence
  Description of Artificial Sequence: Synthetic primer
aatctcggttcctattttaatgttcagac

SEQ ID NO: 1500 - DNA, 31 bp, Artificial Sequence
  Description of Artificial Sequence: Synthetic primer
tccaatcggtatcaataatttatctcaaagt

SEQ ID NO: 1501 - DNA, 24 bp, Artificial Sequence
  Description of Artificial Sequence: Synthetic primer
gataacggcaatttctcggaactt

SEQ ID NO: 1502 - DNA, 20 bp, Artificial Sequence
  Description of Artificial Sequence: Synthetic primer
cctttcgcttcaccttccag

SEQ ID NO: 1503 - DNA, 24 bp, Artificial Sequence
  Description of Artificial Sequence: Synthetic primer
gataacggcaatttcagcgaatta

SEQ ID NO: 1504 - DNA, 21 bp, Artificial Sequence
  Description of Artificial Sequence: Synthetic primer
tatcacccgcaacgtcaatca

SEQ ID NO: 1505 - DNA, 21 bp, Artificial Sequence
  Description of Artificial Sequence: Synthetic primer
gtggccgatataaccgagaac

SEQ ID NO: 1506 - DNA, 21 bp, Artificial Sequence
  Description of Artificial Sequence: Synthetic primer
tatcacccgcaacgtcaaagc

SEQ ID NO: 1507 - DNA, 21 bp, Artificial Sequence
  Description of Artificial Sequence: Synthetic primer
ggctacaaccatcacctttcg

SEQ ID NO: 1508 - DNA, 21 bp, Artificial Sequence
  Description of Artificial Sequence: Synthetic primer
cactgagtgaactgagcctga

SEQ ID NO: 1509 - DNA, 21 bp, Artificial Sequence
  Description of Artificial Sequence: Synthetic primer
ggctacaaccatcaccttagc

SEQ ID NO: 1510 - DNA, 30 bp, Artificial Sequence
  Description of Artificial Sequence: Synthetic primer
aaaatacttccagcctctatttatgtactt

SEQ ID NO: 1511 - DNA, 20 bp, Artificial Sequence
  Description of Artificial Sequence: Synthetic primer
caataaaccgcagcgcagag

SEQ ID NO: 1512 - DNA, 30 bp, Artificial Sequence
  Description of Artificial Sequence: Synthetic primer
aaaatattgccagcctctatttatgtatta

SEQ ID NO: 1513 - DNA, 23 bp, Artificial Sequence
  Description of Artificial Sequence: Synthetic primer
cgaaaggagaaacactgatgtca

SEQ ID NO: 1514 - DNA, 23 bp, Artificial Sequence
  Description of Artificial Sequence: Synthetic primer
aagagatccgacgaaatgagcat

SEQ ID NO: 1515 - DNA, 23 bp, Artificial Sequence
  Description of Artificial Sequence: Synthetic primer
cgaaaggagaaacactgatgagc

SEQ ID NO: 1516 - DNA, 25 bp, Artificial Sequence
  Description of Artificial Sequence: Synthetic primer
tccctggatcaatttatcgaagcat

SEQ ID NO: 1517 - DNA, 22 bp, Artificial Sequence
  Description of Artificial Sequence: Synthetic primer
gaaatcgttcgggaaggcaatc

SEQ ID NO: 1518 - DNA, 25 bp, Artificial Sequence
  Description of Artificial Sequence: Synthetic primer
agcctggatcaatttatcgaagcaa

SEQ ID NO: 1519 - DNA, 23 bp, Artificial Sequence
  Description of Artificial Sequence: Synthetic primer
aactgtatgagcgttatcagcga

SEQ ID NO: 1520 - DNA, 18 bp, Artificial Sequence
  Description of Artificial Sequence: Synthetic primer
cctcacggctaggttcgc

SEQ ID NO: 1521 - DNA, 23 bp, Artificial Sequence
  Description of Artificial Sequence: Synthetic primer
aactgtatgagcgttatcagagg

SEQ ID NO: 1522 - DNA, 22 bp, Artificial Sequence
  Description of Artificial Sequence: Synthetic primer
gcagccattcgtgttcttttga

SEQ ID NO: 1523 - DNA, 23 bp, Artificial Sequence
  Description of Artificial Sequence: Synthetic primer
cgatctgtttattgccaccactg

SEQ ID NO: 1524 - DNA, 22 bp, Artificial Sequence
  Description of Artificial Sequence: Synthetic primer
gcagccattcgtgttctttgct

SEQ ID NO: 1525 - DNA, 20 bp, Artificial Sequence
  Description of Artificial Sequence: Synthetic primer
tccagtcctagccagtgtga

SEQ ID NO: 1526 - DNA, 19 bp, Artificial Sequence
  Description of Artificial Sequence: Synthetic primer
gggagaaatcaccgccatg

SEQ ID NO: 1527 - DNA, 20 bp, Artificial Sequence
  Description of Artificial Sequence: Synthetic primer
tccagtcctaaccagtggct

SEQ ID NO: 1528 - DNA, 26 bp, Artificial Sequence
  Description of Artificial Sequence: Synthetic primer
tgtttacaggcaaattgaggtagtag

SEQ ID NO: 1529 - DNA, 21 bp, Artificial Sequence
  Description of Artificial Sequence: Synthetic primer
cagtttttgcccttgttccgt

SEQ ID NO: 1530 - DNA, 26 bp, Artificial Sequence
  Description of Artificial Sequence: Synthetic primer
tgtttacaggcaaattgaggcaataa

SEQ ID NO: 1531 - DNA, 27 bp, Artificial Sequence
  Description of Artificial Sequence: Synthetic primer
tatttttccatcagatagcgcttagga

SEQ ID NO: 1532 - DNA, 23 bp, Artificial Sequence
  Description of Artificial Sequence: Synthetic primer
ggaaaattatcgccaccatgctt

SEQ ID NO: 1533 - DNA, 27 bp, Artificial Sequence
  Description of Artificial Sequence: Synthetic primer
tatttttccatcagatagcgcctaact

SEQ ID NO: 1534 - DNA, 20 bp, Artificial Sequence
  Description of Artificial Sequence: Synthetic primer
ggtttcttcaccgtcactga

SEQ ID NO: 1535 - DNA, 27 bp, Artificial Sequence
  Description of Artificial Sequence: Synthetic primer
gcataattcccgtcatcaaacttctag

SEQ ID NO: 1536 - DNA, 20 bp, Artificial Sequence
  Description of Artificial Sequence: Synthetic primer
ggtttcttcaccgtcacgct

SEQ ID NO: 1537 - DNA, 23 bp, Artificial Sequence
  Description of Artificial Sequence: Synthetic primer
ttgccgccaaaatattcgtatga

SEQ ID NO: 1538 - DNA, 18 bp, Artificial Sequence
  Description of Artificial Sequence: Synthetic primer
gcgctactcggttcggaa

SEQ ID NO: 1539 - DNA, 23 bp, Artificial Sequence
  Description of Artificial Sequence: Synthetic primer
ttgccgccaaaatattcgtagct

SEQ ID NO: 1540 - DNA, 24 bp, Artificial Sequence
  Description of Artificial Sequence: Synthetic primer
gcttttcaggcttactcgctttcc

SEQ ID NO: 1541 - DNA, 22 bp, Artificial Sequence
  Description of Artificial Sequence: Synthetic primer
ctgaccgttgatattgttgcct

SEQ ID NO: 1542 - DNA, 24 bp, Artificial Sequence
  Description of Artificial Sequence: Synthetic primer
gcttttcaggcttacagtttgagt

SEQ ID NO: 1543 - DNA, 24 bp, Artificial Sequence
  Description of Artificial Sequence: Synthetic primer
aaatcgatcgaactcggtgtatca

SEQ ID NO: 1544 - DNA, 24 bp, Artificial Sequence
  Description of Artificial Sequence: Synthetic primer
gtctttacgcatcaggatcacatc

SEQ ID NO: 1545 - DNA, 24 bp, Artificial Sequence
  Description of Artificial Sequence: Synthetic primer
aaatcgatcgaactcggtgtaagc

SEQ ID NO: 1546 - DNA, 22 bp, Artificial Sequence
  Description of Artificial Sequence: Synthetic primer
ggttaaacttcctccgctgtca

SEQ ID NO: 1547 - DNA, 20 bp, Artificial Sequence
  Description of Artificial Sequence: Synthetic primer
cgcgaaccaaacagcgtatt

SEQ ID NO: 1548 - DNA, 22 bp, Artificial Sequence
  Description of Artificial Sequence: Synthetic primer
ggttaaattacctccgctgagt

SEQ ID NO: 1549 - DNA, 21 bp, Artificial Sequence
  Description of Artificial Sequence: Synthetic primer
ccgcactggttatgggttttt

SEQ ID NO: 1550 - DNA, 18 bp, Artificial Sequence
  Description of Artificial Sequence: Synthetic primer
gtcacggccatcaagcac

SEQ ID NO: 1551 - DNA, 21 bp, Artificial Sequence
  Description of Artificial Sequence: Synthetic primer
ccgcactggttatgggtttta

SEQ ID NO: 1552 - DNA, 23 bp, Artificial Sequence
  Description of Artificial Sequence: Synthetic primer
ctaaacagcaagcgaatcagtca

SEQ ID NO: 1553 - DNA, 25 bp, Artificial Sequence
  Description of Artificial Sequence: Synthetic primer
cagagatgttgaagaagtcgaatgc

SEQ ID NO: 1554 - DNA, 23 bp, Artificial Sequence
  Description of Artificial Sequence: Synthetic primer
ctaaacagcaagcgaatcagagc

SEQ ID NO: 1555 - DNA, 24 bp, Artificial Sequence
  Description of Artificial Sequence: Synthetic primer
tccagacggaagatactgaatact

SEQ ID NO: 1556 - DNA, 21 bp, Artificial Sequence
  Description of Artificial Sequence: Synthetic primer
cagaggattttcgggatgtcg

SEQ ID NO: 1557 - DNA, 24 bp, Artificial Sequence
  Description of Artificial Sequence: Synthetic primer
tccagacggaagatactgaataca

SEQ ID NO: 1558 - DNA, 23 bp, Artificial Sequence
  Description of Artificial Sequence: Synthetic primer
tgttaagctgaccaacaccatct

SEQ ID NO: 1559 - DNA, 19 bp, Artificial Sequence
  Description of Artificial Sequence: Synthetic primer
gccaccagcgaataggtca

SEQ ID NO: 1560 - DNA, 23 bp, Artificial Sequence
  Description of Artificial Sequence: Synthetic primer
tgttaagctgaccaacaccatca

SEQ ID NO: 1561 - DNA, 21 bp, Artificial Sequence
  Description of Artificial Sequence: Synthetic primer
cgtcggtacttattggtgcct

SEQ ID NO: 1562 - DNA, 21 bp, Artificial Sequence
  Description of Artificial Sequence: Synthetic primer
gggctatcttgaccgactgac

SEQ ID NO: 1563 - DNA, 21 bp, Artificial Sequence
  Description of Artificial Sequence: Synthetic primer
cgtcggtattgattggtgcca

SEQ ID NO: 1564 - DNA, 27 bp, Artificial Sequence
  Description of Artificial Sequence: Synthetic primer
gcgaactatctggataacttctccctt

SEQ ID NO: 1565 - DNA, 24 bp, Artificial Sequence
  Description of Artificial Sequence: Synthetic primer
tcgacatcttccagaccaatatgc

SEQ ID NO: 1566 - DNA, 27 bp, Artificial Sequence
  Description of Artificial Sequence: Synthetic primer
gcgaactatctggataacttcagttta

SEQ ID NO: 1567 - DNA, 22 bp, Artificial Sequence
  Description of Artificial Sequence: Synthetic primer
ccggcttcatcatcttcgaaag

SEQ ID NO: 1568 - DNA, 23 bp, Artificial Sequence
  Description of Artificial Sequence: Synthetic primer
cgagaaagtgaagggcgataaag

SEQ ID NO: 1569 - DNA, 22 bp, Artificial Sequence
  Description of Artificial Sequence: Synthetic primer
ccggcttcatcatcttcgataa

SEQ ID NO: 1570 - DNA, 29 bp, Artificial Sequence
  Description of Artificial Sequence: Synthetic primer
gcattgacaagttttttaacctgtgatag

SEQ ID NO: 1571 - DNA, 25 bp, Artificial Sequence
  Description of Artificial Sequence: Synthetic primer
ttatcatgtggcgtaaagaaacagg

SEQ ID NO: 1572 - DNA, 29 bp, Artificial Sequence
  Description of Artificial Sequence: Synthetic primer
gcattgacaagttttttaacctgactcaa

SEQ ID NO: 1573 - DNA, 24 bp, Artificial Sequence
  Description of Artificial Sequence: Synthetic primer
caaccgctacttctatctcttctt

SEQ ID NO: 1574 - DNA, 28 bp, Artificial Sequence
  Description of Artificial Sequence: Synthetic primer
cgaagatcgtatacttcaagcaatgatt

SEQ ID NO: 1575 - DNA, 24 bp, Artificial Sequence
  Description of Artificial Sequence: Synthetic primer
caaccgctattgctaagtttgttg

SEQ ID NO: 1576 - DNA, 19 bp, Artificial Sequence
  Description of Artificial Sequence: Synthetic primer
ggtatgcctgttcccgtga

SEQ ID NO: 1577 - DNA, 22 bp, Artificial Sequence
  Description of Artificial Sequence: Synthetic primer
tcatcgtctattcaacgggcaa

SEQ ID NO: 1578 - DNA, 19 bp, Artificial Sequence
  Description of Artificial Sequence: Synthetic primer
ggtatgcctgttcccggct

SEQ ID NO: 1579 - DNA, 26 bp, Artificial Sequence
  Description of Artificial Sequence: Synthetic primer
agattgaccctaataataacccctca

SEQ ID NO: 1580 - DNA, 25 bp, Artificial Sequence
  Description of Artificial Sequence: Synthetic primer
ctggtactggattgtattgatcgct

SEQ ID NO: 1581 - DNA, 26 bp, Artificial Sequence
  Description of Artificial Sequence: Synthetic primer
agattgaccctaataataaccccagc

SEQ ID NO: 1582 - DNA, 26 bp, Artificial Sequence
  Description of Artificial Sequence: Synthetic primer
ctcttaaattcaaactggcccttctt

SEQ ID NO: 1583 - DNA, 19 bp, Artificial Sequence
  Description of Artificial Sequence: Synthetic primer
agtaagtgccgccagtgag

SEQ ID NO: 1584 - DNA, 26 bp, Artificial Sequence
  Description of Artificial Sequence: Synthetic primer
gccttaaattcaaactggccttgttg

SEQ ID NO: 1585 - DNA, 18 bp, Artificial Sequence
  Description of Artificial Sequence: Synthetic primer
ccgcacctgatcccatca

SEQ ID NO: 1586 - DNA, 19 bp, Artificial Sequence
  Description of Artificial Sequence: Synthetic primer
cgtcgagcatctcctgtgg

SEQ ID NO: 1587 - DNA, 18 bp, Artificial Sequence
  Description of Artificial Sequence: Synthetic primer
ccgcacctgatcccaagc

SEQ ID NO: 1588 - DNA, 24 bp, Artificial Sequence
  Description of Artificial Sequence: Synthetic primer
caatcacaaccaaacgactcatca

SEQ ID NO: 1589 - DNA, 18 bp, Artificial Sequence
  Description of Artificial Sequence: Synthetic primer
gaaccagtcgccccagga

SEQ ID NO: 1590 - DNA, 24 bp, Artificial Sequence
  Description of Artificial Sequence: Synthetic primer
caatcacaaccaaacgacagcagt

SEQ ID NO: 1591 - DNA, 19 bp, Artificial Sequence
  Description of Artificial Sequence: Synthetic primer
agccagttccgggtcgatt

SEQ ID NO: 1592 - DNA, 21 bp, Artificial Sequence
  Description of Artificial Sequence: Synthetic primer
gttaacggctgaaggacatcg

SEQ ID NO: 1593 - DNA, 19 bp, Artificial Sequence
  Description of Artificial Sequence: Synthetic primer
agccagttccgggtcgatg

SEQ ID NO: 1594 - DNA, 24 bp, Artificial Sequence
  Description of Artificial Sequence: Synthetic primer
ggtacgaatcgacatatagcctga

SEQ ID NO: 1595 - DNA, 28 bp, Artificial Sequence
  Description of Artificial Sequence: Synthetic primer
catttgttgttattttgcacggtttttg

SEQ ID NO: 1596 - DNA, 24 bp, Artificial Sequence
  Description of Artificial Sequence: Synthetic primer
ggtacgaatcgacatatagccact

SEQ ID NO: 1597 - DNA, 29 bp, Artificial Sequence
  Description of Artificial Sequence: Synthetic primer
acaactataacttctgtcttgatggtctt

SEQ ID NO: 1598 - DNA, 22 bp, Artificial Sequence
  Description of Artificial Sequence: Synthetic primer
ggtttgccggacatttttgaga

SEQ ID NO: 1599 - DNA, 29 bp, Artificial Sequence
  Description of Artificial Sequence: Synthetic primer
acaactataacttctgtcttgatggtttg

SEQ ID NO: 1600 - DNA, 24 bp, Artificial Sequence
  Description of Artificial Sequence: Synthetic primer
aacgaacgtaataccaaaccctct

SEQ ID NO: 1601 - DNA, 20 bp, Artificial Sequence
  Description of Artificial Sequence: Synthetic primer
cgtccagtctgaacgtttgc

SEQ ID NO: 1602 - DNA, 24 bp, Artificial Sequence
  Description of Artificial Sequence: Synthetic primer
aacgaacgtaataccaaacccagc

SEQ ID NO: 1603 - DNA, 24 bp, Artificial Sequence
  Description of Artificial Sequence: Synthetic primer
tgagatgtatgagtcgccaataga

SEQ ID NO: 1604 - DNA, 30 bp, Artificial Sequence
  Description of Artificial Sequence: Synthetic primer
cctgaagataagtaagatttgacataaccg

SEQ ID NO: 1605 - DNA, 24 bp, Artificial Sequence
  Description of Artificial Sequence: Synthetic primer
actgatgtatgagtcgccaatgct

SEQ ID NO: 1606 - DNA, 28 bp, Artificial Sequence
  Description of Artificial Sequence: Synthetic primer
tattcaggccattcataagcagaaatga

SEQ ID NO: 1607 - DNA, 24 bp, Artificial Sequence
  Description of Artificial Sequence: Synthetic primer
ttcgtacactaattacccttcgca

SEQ ID NO: 1608 - DNA, 28 bp, Artificial Sequence
  Description of Artificial Sequence: Synthetic primer
tattcaggccattcataagcagaaaact

SEQ ID NO: 1609 - DNA, 26 bp, Artificial Sequence
  Description of Artificial Sequence: Synthetic primer
aagaagagctttcaaagattcgttca

SEQ ID NO: 1610 - DNA, 20 bp, Artificial Sequence
  Description of Artificial Sequence: Synthetic primer
cgtgatgagtgtccgccata

SEQ ID NO: 1611 - DNA, 26 bp, Artificial Sequence
  Description of Artificial Sequence: Synthetic primer
aagaagagttgagtaagattcgtagc

SEQ ID NO: 1612 - DNA, 24 bp, Artificial Sequence
  Description of Artificial Sequence: Synthetic primer
gcaaaaatggactggtacctgaag

SEQ ID NO: 1613 - DNA, 23 bp, Artificial Sequence
  Description of Artificial Sequence: Synthetic primer
tagattgtcgtcaggatgccttc

SEQ ID NO: 1614 - DNA, 24 bp, Artificial Sequence
  Description of Artificial Sequence: Synthetic primer
gcaaaaatggactggtatctgaaa

SEQ ID NO: 1615 - DNA, 30 bp, Artificial Sequence
  Description of Artificial Sequence: Synthetic primer
gtttttacctagataacctgaaatgactga

SEQ ID NO: 1616 - DNA, 18 bp, Artificial Sequence
  Description of Artificial Sequence: Synthetic primer
gcaccgcgtgtttcactc

SEQ ID NO: 1617 - DNA, 30 bp, Artificial Sequence
  Description of Artificial Sequence: Synthetic primer
gtttttacctaaataaccgctaatgacgct

SEQ ID NO: 1618 - DNA, 22 bp, Artificial Sequence
  Description of Artificial Sequence: Synthetic primer
gcgccgattcaatacccgaaag

SEQ ID NO: 1619 - DNA, 18 bp, Artificial Sequence
  Description of Artificial Sequence: Synthetic primer
cctacgccaacccgaaca

SEQ ID NO: 1620 - DNA, 22 bp, Artificial Sequence
  Description of Artificial Sequence: Synthetic primer
gcgccgattcaataccacttaa

SEQ ID NO: 1621 - DNA, 30 bp, Artificial Sequence
  Description of Artificial Sequence: Synthetic primer
cttctaaaaataacgcctgttctcatatca

SEQ ID NO: 1622 - DNA, 22 bp, Artificial Sequence
  Description of Artificial Sequence: Synthetic primer
cctcccgggtaaaatattgctt

SEQ ID NO: 1623 - DNA, 30 bp, Artificial Sequence
  Description of Artificial Sequence: Synthetic primer
ttactaaaaataacgcctgttttaataagc

SEQ ID NO: 1624 - DNA, 23 bp, Artificial Sequence
  Description of Artificial Sequence: Synthetic primer
taacccatcgaaaccgcagaaag

SEQ ID NO: 1625 - DNA, 22 bp, Artificial Sequence
  Description of Artificial Sequence: Synthetic primer
atcatttcagggattgcagtgc

SEQ ID NO: 1626 - DNA, 23 bp, Artificial Sequence
  Description of Artificial Sequence: Synthetic primer
taacccatcgaaaccgcacttaa

SEQ ID NO: 1627 - DNA, 27 bp, Artificial Sequence
  Description of Artificial Sequence: Synthetic primer
cacgctatgccaaatattgttctatca

SEQ ID NO: 1628 - DNA, 22 bp, Artificial Sequence
  Description of Artificial Sequence: Synthetic primer
cgttaatgcgattcaccggaac

SEQ ID NO: 1629 - DNA, 27 bp, Artificial Sequence
  Description of Artificial Sequence: Synthetic primer
cacgctatgccaaatattgttttaagc

SEQ ID NO: 1630 - DNA, 27 bp, Artificial Sequence
  Description of Artificial Sequence: Synthetic primer
gatgcgattttctggtttactcttctc

SEQ ID NO: 1631 - DNA, 24 bp, Artificial Sequence
  Description of Artificial Sequence: Synthetic primer
cgatgtcaccacgttaatatgcac

SEQ ID NO: 1632 - DNA, 27 bp, Artificial Sequence
  Description of Artificial Sequence: Synthetic primer
gatgcgattttctggtttactttgttg

SEQ ID NO: 1633 - DNA, 24 bp, Artificial Sequence
  Description of Artificial Sequence: Synthetic primer
gtttacctctgcaacgctatcttc

SEQ ID NO: 1634 - DNA, 23 bp, Artificial Sequence
  Description of Artificial Sequence: Synthetic primer
tgtgtgaatcgggtgttaacaga

SEQ ID NO: 1635 - DNA, 24 bp, Artificial Sequence
  Description of Artificial Sequence: Synthetic primer
gtttacctctgcaacgctaagtag

SEQ ID NO: 1636 - DNA, 22 bp, Artificial Sequence
  Description of Artificial Sequence: Synthetic primer
accactttcgcagatcctctct

SEQ ID NO: 1637 - DNA, 24 bp, Artificial Sequence
  Description of Artificial Sequence: Synthetic primer
ggtgaaagcgcgaagtaacaaata

SEQ ID NO: 1638 - DNA, 22 bp, Artificial Sequence
  Description of Artificial Sequence: Synthetic primer
accacttagccagatcttaagc

SEQ ID NO: 1639 - DNA, 19 bp, Artificial Sequence
  Description of Artificial Sequence: Synthetic primer
ccagcagcagatccagtga

SEQ ID NO: 1640 - DNA, 26 bp, Artificial Sequence
  Description of Artificial Sequence: Synthetic primer
ctgatctttacctggttctgtatgct

SEQ ID NO: 1641 - DNA, 19 bp, Artificial Sequence
  Description of Artificial Sequence: Synthetic primer
ccagcagcagatccagact

SEQ ID NO: 1642 - DNA, 23 bp, Artificial Sequence
  Description of Artificial Sequence: Synthetic primer
cgttccataagcgtttgttccga

SEQ ID NO: 1643 - DNA, 20 bp, Artificial Sequence
  Description of Artificial Sequence: Synthetic primer
gcacttacgcttgcaggatg

SEQ ID NO: 1644 - DNA, 23 bp, Artificial Sequence
  Description of Artificial Sequence: Synthetic primer
ctttccattaacgtttgttcgct

SEQ ID NO: 1645 - DNA, 22 bp, Artificial Sequence
  Description of Artificial Sequence: Synthetic primer
gccgcacgttatgaagatgaat

SEQ ID NO: 1646 - DNA, 18 bp, Artificial Sequence
  Description of Artificial Sequence: Synthetic primer
cgcaagcacctaccggat

SEQ ID NO: 1647 - DNA, 22 bp, Artificial Sequence
  Description of Artificial Sequence: Synthetic primer
gccgcacgttatgaagatgaaa

SEQ ID NO: 1648 - DNA, 23 bp, Artificial Sequence
  Description of Artificial Sequence: Synthetic primer
ggcctttgttttccagattctca

SEQ ID NO: 1649 - DNA, 18 bp, Artificial Sequence
  Description of Artificial Sequence: Synthetic primer
cgcctgctcaccggtatt

SEQ ID NO: 1650 - DNA, 23 bp, Artificial Sequence
  Description of Artificial Sequence: Synthetic primer
ggcctttgttttccagattctcc

SEQ ID NO: 1651 - DNA, 18 bp, Artificial Sequence
  Description of Artificial Sequence: Synthetic primer
tgagggcgacgcaatctc

SEQ ID NO: 1652 - DNA, 24 bp, Artificial Sequence
  Description of Artificial Sequence: Synthetic primer
cgcacgattatagttacgctcaat

SEQ ID NO: 1653 - DNA, 18 bp, Artificial Sequence
  Description of Artificial Sequence: Synthetic primer
tgagggcgacgcaatcag

SEQ ID NO: 1654 - DNA, 18 bp, Artificial Sequence
  Description of Artificial Sequence: Synthetic primer
tggctgacgtcggtatgc

SEQ ID NO: 1655 - DNA, 20 bp, Artificial Sequence
  Description of Artificial Sequence: Synthetic primer
tcgatgaggtgaagcaggac

SEQ ID NO: 1656 - DNA, 18 bp, Artificial Sequence
  Description of Artificial Sequence: Synthetic primer
tggctgacgtcggtatgt

SEQ ID NO: 1657 - DNA, 25 bp, Artificial Sequence
  Description of Artificial Sequence: Synthetic primer
tcatcatcaccgtagaatgaagaag

SEQ ID NO: 1658 - DNA, 19 bp, Artificial Sequence
  Description of Artificial Sequence: Synthetic primer
gtctgattggcgggcaaat

SEQ ID NO: 1659 - DNA, 25 bp, Artificial Sequence
  Description of Artificial Sequence: Synthetic primer
tcatcatcaccgtactatgcaacaa

SEQ ID NO: 1660 - DNA, 21 bp, Artificial Sequence
  Description of Artificial Sequence: Synthetic primer
gaggcccgactgatcatttca

SEQ ID NO: 1661 - DNA, 23 bp, Artificial Sequence
  Description of Artificial Sequence: Synthetic primer
tggaatgacatactcaggttcgc

SEQ ID NO: 1662 - DNA, 21 bp, Artificial Sequence
  Description of Artificial Sequence: Synthetic primer
gaggccagactgatcattagc

SEQ ID NO: 1663 - DNA, 24 bp, Artificial Sequence
  Description of Artificial Sequence: Synthetic primer
catcatcttctcaaacaccgcaag

SEQ ID NO: 1664 - DNA, 26 bp, Artificial Sequence
  Description of Artificial Sequence: Synthetic primer
aaaattttcgccatgtattaccaggt

SEQ ID NO: 1665 - DNA, 24 bp, Artificial Sequence
  Description of Artificial Sequence: Synthetic primer
catcatcttctcaaacaccgctaa

SEQ ID NO: 1666 - DNA, 23 bp, Artificial Sequence
  Description of Artificial Sequence: Synthetic primer
gcttcgcgtattcctgatagtct

SEQ ID NO: 1667 - DNA, 22 bp, Artificial Sequence
  Description of Artificial Sequence: Synthetic primer
ccggaatatcgctaaagatcgc

SEQ ID NO: 1668 - DNA, 23 bp, Artificial Sequence
  Description of Artificial Sequence: Synthetic primer
gcttcgcgtattcctgatagtcg

SEQ ID NO: 1669 - DNA, 25 bp, Artificial Sequence
  Description of Artificial Sequence: Synthetic primer
cgatctaaaagtgggcaaattctca

SEQ ID NO: 1670 - DNA, 22 bp, Artificial Sequence
  Description of Artificial Sequence: Synthetic primer
gtgtgaagagttccaccatgag

SEQ ID NO: 1671 - DNA, 25 bp, Artificial Sequence
  Description of Artificial Sequence: Synthetic primer
cgatctaaaagtgggcaaattcagc

SEQ ID NO: 1672 - DNA, 21 bp, Artificial Sequence
  Description of Artificial Sequence: Synthetic primer
cagggtcagttttacccctga

SEQ ID NO: 1673 - DNA, 22 bp, Artificial Sequence
  Description of Artificial Sequence: Synthetic primer
cactcctgactccttttgacca

SEQ ID NO: 1674 - DNA, 21 bp, Artificial Sequence
  Description of Artificial Sequence: Synthetic primer
cagggtcagttttaccccact

SEQ ID NO: 1675 - DNA, 22 bp, Artificial Sequence
  Description of Artificial Sequence: Synthetic primer
ttttacgagcgccatgtcaaac

SEQ ID NO: 1676 - DNA, 19 bp, Artificial Sequence
  Description of Artificial Sequence: Synthetic primer
cgacaaagtccggcaaacc

SEQ ID NO: 1677 - DNA, 22 bp, Artificial Sequence
  Description of Artificial Sequence: Synthetic primer
ttttacgagcgccatgtcaaat

SEQ ID NO: 1678 - DNA, 21 bp, Artificial Sequence
  Description of Artificial Sequence: Synthetic primer
cacagcagtagggatatgcga

SEQ ID NO: 1679 - DNA, 21 bp, Artificial Sequence
  Description of Artificial Sequence: Synthetic primer
cgctaaacttgcgtgactaca

SEQ ID NO: 1680 - DNA, 21 bp, Artificial Sequence
  Description of Artificial Sequence: Synthetic primer
cacagcagtagggatatggct

SEQ ID NO: 1681 - DNA, 23 bp, Artificial Sequence
  Description of Artificial Sequence: Synthetic primer
gaattccggtaaccagattgaca

SEQ ID NO: 1682 - DNA, 22 bp, Artificial Sequence
  Description of Artificial Sequence: Synthetic primer
gaagccggtcgaatttactacc

SEQ ID NO: 1683 - DNA, 23 bp, Artificial Sequence
  Description of Artificial Sequence: Synthetic primer
gaattccggtaaccagattgacg

SEQ ID NO: 1684 - DNA, 19 bp, Artificial Sequence
  Description of Artificial Sequence: Synthetic primer
ggcctggtatcactctcct

SEQ ID NO: 1685 - DNA, 20 bp, Artificial Sequence
  Description of Artificial Sequence: Synthetic primer
gccgtttccagcgcaatatt

SEQ ID NO: 1686 - DNA, 19 bp, Artificial Sequence
  Description of Artificial Sequence: Synthetic primer
ggcctggtaagcctctcca

SEQ ID NO: 1687 - DNA, 24 bp, Artificial Sequence
  Description of Artificial Sequence: Synthetic primer
cacgtcttcaacctgttattcgtc

SEQ ID NO: 1688 - DNA, 22 bp, Artificial Sequence
  Description of Artificial Sequence: Synthetic primer
gtattcgcagtacccaggtcaa

SEQ ID NO: 1689 - DNA, 24 bp, Artificial Sequence
  Description of Artificial Sequence: Synthetic primer
gtcgtttacaacctgttattcgtt

SEQ ID NO: 1690 - DNA, 29 bp, Artificial Sequence
  Description of Artificial Sequence: Synthetic primer
atgaatatctgaaatctctaggtgcttca

SEQ ID NO: 1691 - DNA, 24 bp, Artificial Sequence
  Description of Artificial Sequence: Synthetic primer
gctgtttagtggagtatcaatgcg

SEQ ID NO: 1692 - DNA, 29 bp, Artificial Sequence
  Description of Artificial Sequence: Synthetic primer
atgaatatctgaaaagtttaggtgctagc

SEQ ID NO: 1693 - DNA, 27 bp, Artificial Sequence
  Description of Artificial Sequence: Synthetic primer
cataagccagttttgaacaattccaga

SEQ ID NO: 1694 - DNA, 20 bp, Artificial Sequence
  Description of Artificial Sequence: Synthetic primer
tctgaagacccggcaagaac

SEQ ID NO: 1695 - DNA, 27 bp, Artificial Sequence
  Description of Artificial Sequence: Synthetic primer
cattaaccagttttgaacaattccgct

SEQ ID NO: 1696 - DNA, 20 bp, Artificial Sequence
  Description of Artificial Sequence: Synthetic primer
cgcttccagggcaacaactt

SEQ ID NO: 1697 - DNA, 22 bp, Artificial Sequence
  Description of Artificial Sequence: Synthetic primer
cgttgctcgcatattctgtagg

SEQ ID NO: 1698 - DNA, 20 bp, Artificial Sequence
  Description of Artificial Sequence: Synthetic primer
cgttaccagggcaacaattg

SEQ ID NO: 1699 - DNA, 20 bp, Artificial Sequence
  Description of Artificial Sequence: Synthetic primer
tgccgattgtgcgtatcctt

SEQ ID NO: 1700 - DNA, 24 bp, Artificial Sequence
  Description of Artificial Sequence: Synthetic primer
gtatttaccagcccaggaattacc

SEQ ID NO: 1701 - DNA, 20 bp, Artificial Sequence
  Description of Artificial Sequence: Synthetic primer
tgccgattgtgcgtatctta

SEQ ID NO: 1702 - DNA, 20 bp, Artificial Sequence
  Description of Artificial Sequence: Synthetic primer
gcacctttaccaccagctga

SEQ ID NO: 1703 - DNA, 19 bp, Artificial Sequence
  Description of Artificial Sequence: Synthetic primer
gttgtgcctggtgaaacgg

SEQ ID NO: 1704 - DNA, 20 bp, Artificial Sequence
  Description of Artificial Sequence: Synthetic primer
gcacctttaccaccagcact

SEQ ID NO: 1705 - DNA, 24 bp, Artificial Sequence
  Description of Artificial Sequence: Synthetic primer
ccaataccttcttctgcgtacatt

SEQ ID NO: 1706 - DNA, 22 bp, Artificial Sequence
  Description of Artificial Sequence: Synthetic primer
tgtcaatcagagggggatttgt

SEQ ID NO: 1707 - DNA, 24 bp, Artificial Sequence
  Description of Artificial Sequence: Synthetic primer
ccaataccttcttctgcgtacatc

SEQ ID NO: 1708 - DNA, 26 bp, Artificial Sequence
  Description of Artificial Sequence: Synthetic primer
acgtgagaatcatcatccagtattag

SEQ ID NO: 1709 - DNA, 23 bp, Artificial Sequence
  Description of Artificial Sequence: Synthetic primer
acccgtagtatccccacttatct

SEQ ID NO: 1710 - DNA, 26 bp, Artificial Sequence
  Description of Artificial Sequence: Synthetic primer
acgtgagaatcatcatccagtatcaa

SEQ ID NO: 1711 - DNA, 19 bp, Artificial Sequence
  Description of Artificial Sequence: Synthetic primer
gcagacgaccgattgcaga

SEQ ID NO: 1712 - DNA, 20 bp, Artificial Sequence
  Description of Artificial Sequence: Synthetic primer
agctgtgggtaaagctgtcg

SEQ ID NO: 1713 - DNA, 19 bp, Artificial Sequence
  Description of Artificial Sequence: Synthetic primer
gcagacgaccgattgcact

SEQ ID NO: 1714 - DNA, 22 bp, Artificial Sequence
  Description of Artificial Sequence: Synthetic primer
gctccgcttctggaaaaaaact

SEQ ID NO: 1715 - DNA, 19 bp, Artificial Sequence
  Description of Artificial Sequence: Synthetic primer
cgaccttcaccaccaccat

SEQ ID NO: 1716 - DNA, 22 bp, Artificial Sequence
  Description of Artificial Sequence: Synthetic primer
gctccgttgctggaaaaaaaca

SEQ ID NO: 1717 - DNA, 22 bp, Artificial Sequence
  Description of Artificial Sequence: Synthetic primer
taagtgcggaagttgccagaag

SEQ ID NO: 1718 - DNA, 24 bp, Artificial Sequence
  Description of Artificial Sequence: Synthetic primer
ctatctctacatccgccagttcaa

SEQ ID NO: 1719 - DNA, 22 bp, Artificial Sequence
  Description of Artificial Sequence: Synthetic primer
ttaatgcggaagttgccagtaa

SEQ ID NO: 1720 - DNA, 22 bp, Artificial Sequence
  Description of Artificial Sequence: Synthetic primer
acaccggagactcatcaactag

SEQ ID NO: 1721 - DNA, 21 bp, Artificial Sequence
  Description of Artificial Sequence: Synthetic primer
cggctgggatgaatttgagtg

SEQ ID NO: 1722 - DNA, 22 bp, Artificial Sequence
  Description of Artificial Sequence: Synthetic primer
tcaccggagactcatcaaccaa

SEQ ID NO: 1723 - DNA, 21 bp, Artificial Sequence
  Description of Artificial Sequence: Synthetic primer
gccgccatttttaccctctca

SEQ ID NO: 1724 - DNA, 27 bp, Artificial Sequence
  Description of Artificial Sequence: Synthetic primer
atccgcttgtagtcagtattattttgc

SEQ ID NO: 1725 - DNA, 21 bp, Artificial Sequence
  Description of Artificial Sequence: Synthetic primer
gccgccatttttaccctcagt

SEQ ID NO: 1726 - DNA, 26 bp, Artificial Sequence
  Description of Artificial Sequence: Synthetic primer
ctgctatttaccgactccttcttctc

SEQ ID NO: 1727 - DNA, 23 bp, Artificial Sequence
  Description of Artificial Sequence: Synthetic primer
ggagataaaaccaagctgaccga

SEQ ID NO: 1728 - DNA, 26 bp, Artificial Sequence
  Description of Artificial Sequence: Synthetic primer
ctgttatttaccgactccttcttcag

SEQ ID NO: 1729 - DNA, 20 bp, Artificial Sequence
  Description of Artificial Sequence: Synthetic primer
catcgcgattatgcccagtc

SEQ ID NO: 1730 - DNA, 18 bp, Artificial Sequence
  Description of Artificial Sequence: Synthetic primer
cgtgactgccgtaccgtt

SEQ ID NO: 1731 - DNA, 20 bp, Artificial Sequence
  Description of Artificial Sequence: Synthetic primer
catcgcgattatgcccagag

SEQ ID NO: 1732 - DNA, 24 bp, Artificial Sequence
  Description of Artificial Sequence: Synthetic primer
atcaaaaacgatctcaagcagctt

SEQ ID NO: 1733 - DNA, 24 bp, Artificial Sequence
  Description of Artificial Sequence: Synthetic primer
tccaggtaaattccatcagcgtta

SEQ ID NO: 1734 - DNA, 24 bp, Artificial Sequence
  Description of Artificial Sequence: Synthetic primer
atcaaaaacgatctcaagcagttg

SEQ ID NO: 1735 - DNA, 22 bp, Artificial Sequence
  Description of Artificial Sequence: Synthetic primer
gcagggtgtagtcgattgatga

SEQ ID NO: 1736 - DNA, 19 bp, Artificial Sequence
  Description of Artificial Sequence: Synthetic primer
gtctacctgtggcgcatca

SEQ ID NO: 1737 - DNA, 22 bp, Artificial Sequence
  Description of Artificial Sequence: Synthetic primer
gcagggtgtagtcgatactgct

SEQ ID NO: 1738 - DNA, 21 bp, Artificial Sequence
  Description of Artificial Sequence: Synthetic primer
cgcattacactctgcagctgt

SEQ ID NO: 1739 - DNA, 20 bp, Artificial Sequence
  Description of Artificial Sequence: Synthetic primer
acctcggcgcaatttgtttc

SEQ ID NO: 1740 - DNA, 21 bp, Artificial Sequence
  Description of Artificial Sequence: Synthetic primer
gccattacactctgcagctga

SEQ ID NO: 1741 - DNA, 23 bp, Artificial Sequence
  Description of Artificial Sequence: Synthetic primer
tcatctgaaaccttccgtgtgag

SEQ ID NO: 1742 - DNA, 26 bp, Artificial Sequence
  Description of Artificial Sequence: Synthetic primer
tactgatgaacccgccaattaatttt

SEQ ID NO: 1743 - DNA, 23 bp, Artificial Sequence
  Description of Artificial Sequence: Synthetic primer
tcatcgctaaccttccttgttaa

SEQ ID NO: 1744 - DNA, 20 bp, Artificial Sequence
  Description of Artificial Sequence: Synthetic primer
tttctcgctgggatgcatca

SEQ ID NO: 1745 - DNA, 24 bp, Artificial Sequence
  Description of Artificial Sequence: Synthetic primer
acatcgttattttccagcacgttc

SEQ ID NO: 1746 - DNA, 20 bp, Artificial Sequence
  Description of Artificial Sequence: Synthetic primer
tttctcgctgggatgcaagt

SEQ ID NO: 1747 - DNA, 27 bp, Artificial Sequence
  Description of Artificial Sequence: Synthetic primer
gtacatgatatcgtttacaacccatca

SEQ ID NO: 1748 - DNA, 20 bp, Artificial Sequence
  Description of Artificial Sequence: Synthetic primer
ccacagaaagcgtcgacaac

SEQ ID NO: 1749 - DNA, 27 bp, Artificial Sequence
  Description of Artificial Sequence: Synthetic primer
gtacatgatatcgtttacaacccaagc

SEQ ID NO: 1750 - DNA, 22 bp, Artificial Sequence
  Description of Artificial Sequence: Synthetic primer
gcttcttctcatcgtcaccctt

SEQ ID NO: 1751 - DNA, 22 bp, Artificial Sequence
  Description of Artificial Sequence: Synthetic primer
gaattcatagtgttgcgcccaa

SEQ ID NO: 1752 - DNA, 22 bp, Artificial Sequence
  Description of Artificial Sequence: Synthetic primer
gttattgctcatcgtcaccttg

SEQ ID NO: 1753 - DNA, 19 bp, Artificial Sequence
  Description of Artificial Sequence: Synthetic primer
cgtgtccatgccgtttctc

SEQ ID NO: 1754 - DNA, 25 bp, Artificial Sequence
  Description of Artificial Sequence: Synthetic primer
aaagttctgtctcgccatttcaaaa

SEQ ID NO: 1755 - DNA, 19 bp, Artificial Sequence
  Description of Artificial Sequence: Synthetic primer
cgtgtccatgccgtttttg

SEQ ID NO: 1756 - DNA, 25 bp, Artificial Sequence
  Description of Artificial Sequence: Synthetic primer
cggaattggcttatcgatacctttt

SEQ ID NO: 1757 - DNA, 18 bp, Artificial Sequence
  Description of Artificial Sequence: Synthetic primer
gtgacccacggcttcctg

SEQ ID NO: 1758 - DNA, 25 bp, Artificial Sequence
  Description of Artificial Sequence: Synthetic primer
cggaattggcttatcgatacctttc

SEQ ID NO: 1759 - DNA, 20 bp, Artificial Sequence
  Description of Artificial Sequence: Synthetic primer
gttcactccggcttatgtca

SEQ ID NO: 1760 - DNA, 18 bp, Artificial Sequence
  Description of Artificial Sequence: Synthetic primer
ggtcgcccatccctcatg

SEQ ID NO: 1761 - DNA, 20 bp, Artificial Sequence
  Description of Artificial Sequence: Synthetic primer
ggagtctgcggttgatgagc

SEQ ID NO: 1762 - DNA, 24 bp, Artificial Sequence
  Description of Artificial Sequence: Synthetic primer
cagcgaggtaagaatccatttacg

SEQ ID NO: 1763 - DNA, 18 bp, Artificial Sequence
  Description of Artificial Sequence: Synthetic primer
ggtgcgctgactatcggt

SEQ ID NO: 1764 - DNA, 24 bp, Artificial Sequence
  Description of Artificial Sequence: Synthetic primer
cagcgaggtcaaaatccattttct

SEQ ID NO: 1765 - DNA, 23 bp, Artificial Sequence
  Description of Artificial Sequence: Synthetic primer
cggtaaatgcggtaagacctgat

SEQ ID NO: 1766 - DNA, 23 bp, Artificial Sequence
  Description of Artificial Sequence: Synthetic primer
tggtggttatcaggtgggaaatt

SEQ ID NO: 1767 - DNA, 23 bp, Artificial Sequence
  Description of Artificial Sequence: Synthetic primer
cggtaaatgcggttaaaccactg

SEQ ID NO: 1768 - DNA, 21 bp, Artificial Sequence
  Description of Artificial Sequence: Synthetic primer
ccctcagcttcaggaaattca

SEQ ID NO: 1769 - DNA, 20 bp, Artificial Sequence
  Description of Artificial Sequence: Synthetic primer
cgttgggatgattgcgttcc

SEQ ID NO: 1770 - DNA, 21 bp, Artificial Sequence
  Description of Artificial Sequence: Synthetic primer
cccagcgcttcaggaaatagc

SEQ ID NO: 1771 - DNA, 18 bp, Artificial Sequence
  Description of Artificial Sequence: Synthetic primer
cctggctggttaccggtt

SEQ ID NO: 1772 - DNA, 19 bp, Artificial Sequence
  Description of Artificial Sequence: Synthetic primer
accttagtaccccgccgta

SEQ ID NO: 1773 - DNA, 18 bp, Artificial Sequence
  Description of Artificial Sequence: Synthetic primer
cctggctggttaccggta

SEQ ID NO: 1774 - DNA, 30 bp, Artificial Sequence
  Description of Artificial Sequence: Synthetic primer
ctcacctttaaacattttagagtaccatga

SEQ ID NO: 1775 - DNA, 24 bp, Artificial Sequence
  Description of Artificial Sequence: Synthetic primer
gagtatgatgtcgaactggcctta

SEQ ID NO: 1776 - DNA, 30 bp, Artificial Sequence
  Description of Artificial Sequence: Synthetic primer
ctcacctttaaacattttgctgtaccaact

SEQ ID NO: 1777 - DNA, 21 bp, Artificial Sequence
  Description of Artificial Sequence: Synthetic primer
gtcaccataggccaggtttga

SEQ ID NO: 1778 - DNA, 20 bp, Artificial Sequence
  Description of Artificial Sequence: Synthetic primer
atgtgcgtctgttccgtgaa

SEQ ID NO: 1779 - DNA, 21 bp, Artificial Sequence
  Description of Artificial Sequence: Synthetic primer
gtcaccataggccaggttact

SEQ ID NO: 1780 - DNA, 19 bp, Artificial Sequence
  Description of Artificial Sequence: Synthetic primer
ctgattatcgccggtgcct

SEQ ID NO: 1781 - DNA, 18 bp, Artificial Sequence
  Description of Artificial Sequence: Synthetic primer
cagtaccgcgggcttgtt

SEQ ID NO: 1782 - DNA, 19 bp, Artificial Sequence
  Description of Artificial Sequence: Synthetic primer
ctgattatcgccggtgcca

SEQ ID NO: 1783 - DNA, 24 bp, Artificial Sequence
  Description of Artificial Sequence: Synthetic primer
tttttttagtcgccacgtcagaag

SEQ ID NO: 1784 - DNA, 21 bp, Artificial Sequence
  Description of Artificial Sequence: Synthetic primer
ggaacggcattgtcacttacg

SEQ ID NO: 1785 - DNA, 24 bp, Artificial Sequence
  Description of Artificial Sequence: Synthetic primer
tttttttaatcgccacgtcagtaa

SEQ ID NO: 1786 - DNA, 27 bp, Artificial Sequence
  Description of Artificial Sequence: Synthetic primer
tcacattgtcagcttgaaaatctctct

SEQ ID NO: 1787 - DNA, 26 bp, Artificial Sequence
  Description of Artificial Sequence: Synthetic primer
tctgttttggagagtgctttaacatc

SEQ ID NO: 1788 - DNA, 27 bp, Artificial Sequence
  Description of Artificial Sequence: Synthetic primer
agccattgtcagcttgaaaatttaagc

SEQ ID NO: 1789 - DNA, 31 bp, Artificial Sequence
  Description of Artificial Sequence: Synthetic primer
caatatttttaatctgggtatcaaagagcta

SEQ ID NO: 1790 - DNA, 18 bp, Artificial Sequence
  Description of Artificial Sequence: Synthetic primer
catcaccccgccaaacca

SEQ ID NO: 1791 - DNA, 31 bp, Artificial Sequence
  Description of Artificial Sequence: Synthetic primer
caatatttttaatctgggtatcaaagagttg

SEQ ID NO: 1792 - DNA, 28 bp, Artificial Sequence
  Description of Artificial Sequence: Synthetic primer
gcgtgctcatattctacgtcgtaataac

SEQ ID NO: 1793 - DNA, 31 bp, Artificial Sequence
  Description of Artificial Sequence: Synthetic primer
tcatcttctatattaagtagctgtgaaagga

SEQ ID NO: 1794 - DNA, 28 bp, Artificial Sequence
  Description of Artificial Sequence: Synthetic primer
gcgtgctcatattctacgtaggaataat

SEQ ID NO: 1795 - DNA, 24 bp, Artificial Sequence
  Description of Artificial Sequence: Synthetic primer
cttcataccgggctgctacttctt

SEQ ID NO: 1796 - DNA, 22 bp, Artificial Sequence
  Description of Artificial Sequence: Synthetic primer
gatgcaggtagaccaaagtacc

SEQ ID NO: 1797 - DNA, 24 bp, Artificial Sequence
  Description of Artificial Sequence: Synthetic primer
ttgcataccgggctgttattattg

SEQ ID NO: 1798 - DNA, 29 bp, Artificial Sequence
  Description of Artificial Sequence: Synthetic primer
ctatcaataaattcaactgggaaacgcta

SEQ ID NO: 1799 - DNA, 18 bp, Artificial Sequence
  Description of Artificial Sequence: Synthetic primer
gcaggaagggcgaagaag

SEQ ID NO: 1800 - DNA, 29 bp, Artificial Sequence
  Description of Artificial Sequence: Synthetic primer
ctatcaataaattcaactgggaaacgttg

SEQ ID NO: 1801 - DNA, 31 bp, Artificial Sequence
  Description of Artificial Sequence: Synthetic primer
taacttcctcactcaaatagaacgacttaag

SEQ ID NO: 1802 - DNA, 22 bp, Artificial Sequence
  Description of Artificial Sequence: Synthetic primer
ttgattcgcaatgcatgacaga

SEQ ID NO: 1803 - DNA, 31 bp, Artificial Sequence
  Description of Artificial Sequence: Synthetic primer
taattttctcactcaaattgaacgattaaaa

SEQ ID NO: 1804 - DNA, 23 bp, Artificial Sequence
  Description of Artificial Sequence: Synthetic primer
cgccgctaccatcaggatattag

SEQ ID NO: 1805 - DNA, 22 bp, Artificial Sequence
  Description of Artificial Sequence: Synthetic primer
gcctctatcactctgaccttcg

SEQ ID NO: 1806 - DNA, 23 bp, Artificial Sequence
  Description of Artificial Sequence: Synthetic primer
cgccgctaccatcaggatattac

SEQ ID NO: 1807 - DNA, 18 bp, Artificial Sequence
  Description of Artificial Sequence: Synthetic primer
cgcccgctcttcatctga

SEQ ID NO: 1808 - DNA, 31 bp, Artificial Sequence
  Description of Artificial Sequence: Synthetic primer
acctgtcaaaaaatataacgcactaatatca

SEQ ID NO: 1809 - DNA, 18 bp, Artificial Sequence
  Description of Artificial Sequence: Synthetic primer
cgcccgctcttcatcact

SEQ ID NO: 1810 - DNA, 19 bp, Artificial Sequence
  Description of Artificial Sequence: Synthetic primer
gtgaggccccctgaattga

SEQ ID NO: 1811 - DNA, 26 bp, Artificial Sequence
  Description of Artificial Sequence: Synthetic primer
catttctttgaccgattgttgttcac

SEQ ID NO: 1812 - DNA, 19 bp, Artificial Sequence
  Description of Artificial Sequence: Synthetic primer
gactggccccctgaatact

SEQ ID NO: 1813 - DNA, 22 bp, Artificial Sequence
  Description of Artificial Sequence: Synthetic primer
tcgccacgacaattaggagtag

SEQ ID NO: 1814 - DNA, 18 bp, Artificial Sequence
  Description of Artificial Sequence: Synthetic primer
gtcttccctggctgcgtt

SEQ ID NO: 1815 - DNA, 22 bp, Artificial Sequence
  Description of Artificial Sequence: Synthetic primer
tcgccacgacaatcaacaacaa

SEQ ID NO: 1816 - DNA, 20 bp, Artificial Sequence
  Description of Artificial Sequence: Synthetic primer
accgccgaacagctttactc

SEQ ID NO: 1817 - DNA, 22 bp, Artificial Sequence
  Description of Artificial Sequence: Synthetic primer
ccatattcgggtgcatcagttg

SEQ ID NO: 1818 - DNA, 20 bp, Artificial Sequence
  Description of Artificial Sequence: Synthetic primer
accgccgaacagctttacag

SEQ ID NO: 1819 - DNA, 30 bp, Artificial Sequence
  Description of Artificial Sequence: Synthetic primer
gataacgagtaattgaagatgaatgtgcta

SEQ ID NO: 1820 - DNA, 18 bp, Artificial Sequence
  Description of Artificial Sequence: Synthetic primer
tttcttgccccacagcca

SEQ ID NO: 1821 - DNA, 30 bp, Artificial Sequence
  Description of Artificial Sequence: Synthetic primer
gataacgagtaattgaagatgaatgtgttg

SEQ ID NO: 1822 - DNA, 24 bp, Artificial Sequence
  Description of Artificial Sequence: Synthetic primer
tgattggggccatttttgttcttc

SEQ ID NO: 1823 - DNA, 22 bp, Artificial Sequence
  Description of Artificial Sequence: Synthetic primer
tattcagccaggcgttaaggtt

SEQ ID NO: 1824 - DNA, 24 bp, Artificial Sequence
  Description of Artificial Sequence: Synthetic primer
tgattggggccatttttgttttat

SEQ ID NO: 1825 - DNA, 24 bp, Artificial Sequence
  Description of Artificial Sequence: Synthetic primer
gctccggtttactcaatcagctta

SEQ ID NO: 1826 - DNA, 22 bp, Artificial Sequence
  Description of Artificial Sequence: Synthetic primer
cgatttgggtttcgtttcgtgt

SEQ ID NO: 1827 - DNA, 24 bp, Artificial Sequence
  Description of Artificial Sequence: Synthetic primer
gctccggtttactcaatcagcttc

SEQ ID NO: 1828 - DNA, 22 bp, Artificial Sequence
  Description of Artificial Sequence: Synthetic primer
ccagagttttagcctgaaccga

SEQ ID NO: 1829 - DNA, 24 bp, Artificial Sequence
  Description of Artificial Sequence: Synthetic primer
gggcaaaaaacaaaaaaggtcagg

SEQ ID NO: 1830 - DNA, 22 bp, Artificial Sequence
  Description of Artificial Sequence: Synthetic primer
ccagagttttagcctgaacact

SEQ ID NO: 1831 - DNA, 23 bp, Artificial Sequence
  Description of Artificial Sequence: Synthetic primer
cggacgtagatgtgggaatttct

SEQ ID NO: 1832 - DNA, 22 bp, Artificial Sequence
  Description of Artificial Sequence: Synthetic primer
gtgtaacgctctgtggaaagtc

SEQ ID NO: 1833 - DNA, 23 bp, Artificial Sequence
  Description of Artificial Sequence: Synthetic primer
cggacgtagatgtgggaatttcg

SEQ ID NO: 1834 - DNA, 25 bp, Artificial Sequence
  Description of Artificial Sequence: Synthetic primer
caaagaccggtttaagatcatctga

SEQ ID NO: 1835 - DNA, 29 bp, Artificial Sequence
  Description of Artificial Sequence: Synthetic primer
acggcactatcattttttaacaatgaaac

SEQ ID NO: 1836 - DNA, 25 bp, Artificial Sequence
  Description of Artificial Sequence: Synthetic primer
caaagaccggtttcaaatcatcgct

SEQ ID NO: 1837 - DNA, 27 bp, Artificial Sequence
  Description of Artificial Sequence: Synthetic primer
taaaaaatcagacaaaggccgatacgt

SEQ ID NO: 1838 - DNA, 22 bp, Artificial Sequence
  Description of Artificial Sequence: Synthetic primer
aacctttacccgttgtgctttc

SEQ ID NO: 1839 - DNA, 27 bp, Artificial Sequence
  Description of Artificial Sequence: Synthetic primer
taaaaaatcagacataagccgatacgc

SEQ ID NO: 1840 - DNA, 20 bp, Artificial Sequence
  Description of Artificial Sequence: Synthetic primer
ccgaaagtgcctgaattgca

SEQ ID NO: 1841 - DNA, 24 bp, Artificial Sequence
  Description of Artificial Sequence: Synthetic primer
cgtataacggtcaggtactttcca

SEQ ID NO: 1842 - DNA, 20 bp, Artificial Sequence
  Description of Artificial Sequence: Synthetic primer
cgcttaatgcctgaattgcc

SEQ ID NO: 1843 - DNA, 28 bp, Artificial Sequence
  Description of Artificial Sequence: Synthetic primer
cttgtttggaggatacctgtttattcga

SEQ ID NO: 1844 - DNA, 25 bp, Artificial Sequence
  Description of Artificial Sequence: Synthetic primer
tttagcgccaatctgaatcgttaac

SEQ ID NO: 1845 - DNA, 28 bp, Artificial Sequence
  Description of Artificial Sequence: Synthetic primer
cttgtttactgcttacctgtttattact

SEQ ID NO: 1846 - DNA, 26 bp, Artificial Sequence
  Description of Artificial Sequence: Synthetic primer
taaggacccgattaaaggctgcttta

SEQ ID NO: 1847 - DNA, 24 bp, Artificial Sequence
  Description of Artificial Sequence: Synthetic primer
tttttttcccatcacttctttccc

SEQ ID NO: 1848 - DNA, 26 bp, Artificial Sequence
  Description of Artificial Sequence: Synthetic primer
ttaagacccgattaaaggctgctttt

SEQ ID NO: 1849 - DNA, 19 bp, Artificial Sequence
  Description of Artificial Sequence: Synthetic primer
ccggactcgagatgacctc

SEQ ID NO: 1850 - DNA, 18 bp, Artificial Sequence
  Description of Artificial Sequence: Synthetic primer
gacacatccgccagcatt

SEQ ID NO: 1851 - DNA, 19 bp, Artificial Sequence
  Description of Artificial Sequence: Synthetic primer
ccggactcgagatgaccag

SEQ ID NO: 1852 - DNA, 20 bp, Artificial Sequence
  Description of Artificial Sequence: Synthetic primer
gggtttactttcgcctgaga

SEQ ID NO: 1853 - DNA, 18 bp, Artificial Sequence
  Description of Artificial Sequence: Synthetic primer
ggtggatcggctgatggc

SEQ ID NO: 1854 - DNA, 20 bp, Artificial Sequence
  Description of Artificial Sequence: Synthetic primer
gggtttactttcgcctggct

SEQ ID NO: 1855 - DNA, 20 bp, Artificial Sequence
  Description of Artificial Sequence: Synthetic primer
cggacgactatggctggatc

SEQ ID NO: 1856 - DNA, 24 bp, Artificial Sequence
  Description of Artificial Sequence: Synthetic primer
cgcatcggtttatttacaccagtc

SEQ ID NO: 1857 - DNA, 20 bp, Artificial Sequence
  Description of Artificial Sequence: Synthetic primer
cggacgattgtggctggatt

SEQ ID NO: 1858 - DNA, 20 bp, Artificial Sequence
  Description of Artificial Sequence: Synthetic primer
tgcgcccgaataaccgtcta

SEQ ID NO: 1859 - DNA, 25 bp, Artificial Sequence
  Description of Artificial Sequence: Synthetic primer
gtctggagtattatcgtcggcttta

SEQ ID NO: 1860 - DNA, 20 bp, Artificial Sequence
  Description of Artificial Sequence: Synthetic primer
tgcgcccgaataacagattg

SEQ ID NO: 1861 - DNA, 20 bp, Artificial Sequence
  Description of Artificial Sequence: Synthetic primer
aggcgatatccgggtcttct

SEQ ID NO: 1862 - DNA, 27 bp, Artificial Sequence
  Description of Artificial Sequence: Synthetic primer
ttactgtcaaacactctctgatcttca

SEQ ID NO: 1863 - DNA, 20 bp, Artificial Sequence
  Description of Artificial Sequence: Synthetic primer
aggcgatatccgggtcttca

SEQ ID NO: 1864 - DNA, 20 bp, Artificial Sequence
  Description of Artificial Sequence: Synthetic primer
ggaacgacacgcccttagat

SEQ ID NO: 1865 - DNA, 22 bp, Artificial Sequence
  Description of Artificial Sequence: Synthetic primer
aacaatgttggtgagcttgaga

SEQ ID NO: 1866 - DNA, 20 bp, Artificial Sequence
  Description of Artificial Sequence: Synthetic primer
ggaaactcacgcccttgctg

SEQ ID NO: 1867 - DNA, 23 bp, Artificial Sequence
  Description of Artificial Sequence: Synthetic primer
ccttgttcgtgttaatcccaaga

SEQ ID NO: 1868 - DNA, 19 bp, Artificial Sequence
  Description of Artificial Sequence: Synthetic primer
gccagcgtttcgtaccatg

SEQ ID NO: 1869 - DNA, 23 bp, Artificial Sequence
  Description of Artificial Sequence: Synthetic primer
ccttgttcgtgttaatcccagct

SEQ ID NO: 1870 - DNA, 21 bp, Artificial Sequence
  Description of Artificial Sequence: Synthetic primer
aagaactcaacgcgctacttc

SEQ ID NO: 1871 - DNA, 19 bp, Artificial Sequence
  Description of Artificial Sequence: Synthetic primer
gcttttatgggggccgaga

SEQ ID NO: 1872 - DNA, 21 bp, Artificial Sequence
  Description of Artificial Sequence: Synthetic primer
aagaactcaacgcgctattgt

SEQ ID NO: 1873 - DNA, 29 bp, Artificial Sequence
  Description of Artificial Sequence: Synthetic primer
actggagcttatcagtgttaattccatac

SEQ ID NO: 1874 - DNA, 28 bp, Artificial Sequence
  Description of Artificial Sequence: Synthetic primer
ttctgaatgtttaaatgttgcctatggt

SEQ ID NO: 1875 - DNA, 29 bp, Artificial Sequence
  Description of Artificial Sequence: Synthetic primer
actggagcttatcagtgttaattctatat

SEQ ID NO: 1876 - DNA, 29 bp, Artificial Sequence
  Description of Artificial Sequence: Synthetic primer
ccaataaaaagcactgcatgatcaataag

SEQ ID NO: 1877 - DNA, 20 bp, Artificial Sequence
  Description of Artificial Sequence: Synthetic primer
cgaggctatcaggttgtgct

SEQ ID NO: 1878 - DNA, 29 bp, Artificial Sequence
  Description of Artificial Sequence: Synthetic primer
ccaataaaaagcactgcatgatcaattaa

SEQ ID NO: 1879 - DNA, 22 bp, Artificial Sequence
  Description of Artificial Sequence: Synthetic primer
gctgggtaaatgggctgatctt

SEQ ID NO: 1880 - DNA, 22 bp, Artificial Sequence
  Description of Artificial Sequence: Synthetic primer
gatggtcttttagtgcggcaac

SEQ ID NO: 1881 - DNA, 22 bp, Artificial Sequence
  Description of Artificial Sequence: Synthetic primer
gctgggtaaatgggctgattta

SEQ ID NO: 1882 - DNA, 31 bp, Artificial Sequence
  Description of Artificial Sequence: Synthetic primer
aaatgagctaaaagaacataacaaacaactt

SEQ ID NO: 1883 - DNA, 25 bp, Artificial Sequence
  Description of Artificial Sequence: Synthetic primer
ggggaggggaaattgataacttgta

SEQ ID NO: 1884 - DNA, 31 bp, Artificial Sequence
  Description of Artificial Sequence: Synthetic primer
aaatgagttgaaagaacataacaaacaattg

SEQ ID NO: 1885 - DNA, 25 bp, Artificial Sequence
  Description of Artificial Sequence: Synthetic primer
gcgaccatctttctcttccgtatta

SEQ ID NO: 1886 - DNA, 21 bp, Artificial Sequence
  Description of Artificial Sequence: Synthetic primer
tgctcaaccatgctctaggtg

SEQ ID NO: 1887 - DNA, 25 bp, Artificial Sequence
  Description of Artificial Sequence: Synthetic primer
gcgaccatctttctcttccgtattc

SEQ ID NO: 1888 - DNA, 21 bp, Artificial Sequence
  Description of Artificial Sequence: Synthetic primer
gcgtggtttatgggcatgcta

SEQ ID NO: 1889 - DNA, 22 bp, Artificial Sequence
  Description of Artificial Sequence: Synthetic primer
ccggttctggaatgtgttgtac

SEQ ID NO: 1890 - DNA, 21 bp, Artificial Sequence
  Description of Artificial Sequence: Synthetic primer
gcgtggtttatgggcatgttg

SEQ ID NO: 1891 - DNA, 26 bp, Artificial Sequence
  Description of Artificial Sequence: Synthetic primer
gacggaattatggttgaaatctggtc

SEQ ID NO: 1892 - DNA, 20 bp, Artificial Sequence
  Description of Artificial Sequence: Synthetic primer
cgacgacatctgggattgct

SEQ ID NO: 1893 - DNA, 26 bp, Artificial Sequence
  Description of Artificial Sequence: Synthetic primer
gacggaattatggttgaaatctggag

SEQ ID NO: 1894 - DNA, 23 bp, Artificial Sequence
  Description of Artificial Sequence: Synthetic primer
gtccaaaagcctcaattctttca

SEQ ID NO: 1895 - DNA, 25 bp, Artificial Sequence
  Description of Artificial Sequence: Synthetic primer
gcaatcttatcaatcacccgaagtc

SEQ ID NO: 1896 - DNA, 23 bp, Artificial Sequence
  Description of Artificial Sequence: Synthetic primer
gtccaaaagccagcattttgagc

SEQ ID NO: 1897 - DNA, 22 bp, Artificial Sequence
  Description of Artificial Sequence: Synthetic primer
gatgattgccttctacgccctt

SEQ ID NO: 1898 - DNA, 21 bp, Artificial Sequence
  Description of Artificial Sequence: Synthetic primer
cgacgggaagataaacatgcc

SEQ ID NO: 1899 - DNA, 22 bp, Artificial Sequence
  Description of Artificial Sequence: Synthetic primer
gatgattgccttctacgcctta

SEQ ID NO: 1900 - DNA, 25 bp, Artificial Sequence
  Description of Artificial Sequence: Synthetic primer
cggaatcggcagaataaaaagaatt

SEQ ID NO: 1901 - DNA, 24 bp, Artificial Sequence
  Description of Artificial Sequence: Synthetic primer
gcctgcttacctcatataaaacgc

SEQ ID NO: 1902 - DNA, 25 bp, Artificial Sequence
  Description of Artificial Sequence: Synthetic primer
cggaatcggcagaataaacaaaata

SEQ ID NO: 1903 - DNA, 19 bp, Artificial Sequence
  Description of Artificial Sequence: Synthetic primer
tacatcgccgccccttttg

SEQ ID NO: 1904 - DNA, 22 bp, Artificial Sequence
  Description of Artificial Sequence: Synthetic primer
cggtatctacgctaaccagtcc

SEQ ID NO: 1905 - DNA, 19 bp, Artificial Sequence
  Description of Artificial Sequence: Synthetic primer
tacatcgccgcccctttac

SEQ ID NO: 1906 - DNA, 26 bp, Artificial Sequence
  Description of Artificial Sequence: Synthetic primer
tgaaatctgcggagttaagtcgaata

SEQ ID NO: 1907 - DNA, 18 bp, Artificial Sequence
  Description of Artificial Sequence: Synthetic primer
tcaccgccagacaagcac

SEQ ID NO: 1908 - DNA, 26 bp, Artificial Sequence
  Description of Artificial Sequence: Synthetic primer
tgaaatctgcggagttaagtcgaatt

SEQ ID NO: 1909 - DNA, 18 bp, Artificial Sequence
  Description of Artificial Sequence: Synthetic primer
aatcccctccagcgacga

SEQ ID NO: 1910 - DNA, 24 bp, Artificial Sequence
  Description of Artificial Sequence: Synthetic primer
tgaggtttatcacgactctctgtg

SEQ ID NO: 1911 - DNA, 18 bp, Artificial Sequence
  Description of Artificial Sequence: Synthetic primer
aatcccctccagcgagct

SEQ ID NO: 1912 - DNA, 31 bp, Artificial Sequence
  Description of Artificial Sequence: Synthetic primer
ctactcgtttaaaggattaatcatgaagcta

SEQ ID NO: 1913 - DNA, 21 bp, Artificial Sequence
  Description of Artificial Sequence: Synthetic primer
gccagtgccttttcttcttcg

SEQ ID NO: 1914 - DNA, 31 bp, Artificial Sequence
  Description of Artificial Sequence: Synthetic primer
ctactcgtttaaaggattaatcatgaagttg

SEQ ID NO: 1915 - DNA, 20 bp, Artificial Sequence
  Description of Artificial Sequence: Synthetic primer
atttccatctccgcaccaga

SEQ ID NO: 1916 - DNA, 18 bp, Artificial Sequence
  Description of Artificial Sequence: Synthetic primer
tgcgcgtacagattggct

SEQ ID NO: 1917 - DNA, 20 bp, Artificial Sequence
  Description of Artificial Sequence: Synthetic primer
atttccatctccgcaccgct

SEQ ID NO: 1918 - DNA, 20 bp, Artificial Sequence
  Description of Artificial Sequence: Synthetic primer
aagcacgtcagggttcactt

SEQ ID NO: 1919 - DNA, 20 bp, Artificial Sequence
  Description of Artificial Sequence: Synthetic primer
gcctgttcaatttcctgcca

SEQ ID NO: 1920 - DNA, 20 bp, Artificial Sequence
  Description of Artificial Sequence: Synthetic primer
aagcacgtcagggtagtttg

SEQ ID NO: 1921 - DNA, 20 bp, Artificial Sequence
  Description of Artificial Sequence: Synthetic primer
ggtttttccggtcgcgaatc

SEQ ID NO: 1922 - DNA, 18 bp, Artificial Sequence
  Description of Artificial Sequence: Synthetic primer
gtccagcgcccaggtatc

SEQ ID NO: 1923 - DNA, 20 bp, Artificial Sequence
  Description of Artificial Sequence: Synthetic primer
ggtttttccggtcgcgaaag

SEQ ID NO: 1924 - DNA, 25 bp, Artificial Sequence
  Description of Artificial Sequence: Synthetic primer
attaccgaagattaccaggaaatgt

SEQ ID NO: 1925 - DNA, 22 bp, Artificial Sequence
  Description of Artificial Sequence: Synthetic primer
gcagttatcgtaccagggctta

SEQ ID NO: 1926 - DNA, 25 bp, Artificial Sequence
  Description of Artificial Sequence: Synthetic primer
attaccgaagattaccaggaaatga

SEQ ID NO: 1927 - DNA, 31 bp, Artificial Sequence
  Description of Artificial Sequence: Synthetic primer
acaatcaggtacttatcttattctattctca

SEQ ID NO: 1928 - DNA, 20 bp, Artificial Sequence
  Description of Artificial Sequence: Synthetic primer
gcaggttgacgccatatacc

SEQ ID NO: 1929 - DNA, 31 bp, Artificial Sequence
  Description of Artificial Sequence: Synthetic primer
acaaagtggtacttatttaattttattcagc

SEQ ID NO: 1930 - DNA, 26 bp, Artificial Sequence
  Description of Artificial Sequence: Synthetic primer
atcagagagacaataatgccacctag

SEQ ID NO: 1931 - DNA, 21 bp, Artificial Sequence
  Description of Artificial Sequence: Synthetic primer
ccgggtgcaattggttatgtt

SEQ ID NO: 1932 - DNA, 26 bp, Artificial Sequence
  Description of Artificial Sequence: Synthetic primer
atcagagagacaataatgccacccaa

SEQ ID NO: 1933 - DNA, 20 bp, Artificial Sequence
  Description of Artificial Sequence: Synthetic primer
atacgtacctgcggatgacc

SEQ ID NO: 1934 - DNA, 21 bp, Artificial Sequence
  Description of Artificial Sequence: Synthetic primer
cattgccatatcaccctccga

SEQ ID NO: 1935 - DNA, 20 bp, Artificial Sequence
  Description of Artificial Sequence: Synthetic primer
atacgtacctgcggatgact

SEQ ID NO: 1936 - DNA, 22 bp, Artificial Sequence
  Description of Artificial Sequence: Synthetic primer
cagctactggtggtgatagcat

SEQ ID NO: 1937 - DNA, 20 bp, Artificial Sequence
  Description of Artificial Sequence: Synthetic primer
cgagaatgtacgcaggtcca

SEQ ID NO: 1938 - DNA, 22 bp, Artificial Sequence
  Description of Artificial Sequence: Synthetic primer
cagttactggtggtgatagcaa

SEQ ID NO: 1939 - DNA, 22 bp, Artificial Sequence
  Description of Artificial Sequence: Synthetic primer
catatagcgcttccagggatga

SEQ ID NO: 1940 - DNA, 18 bp, Artificial Sequence
  Description of Artificial Sequence: Synthetic primer
gcccgcgcgtttgaatat

SEQ ID NO: 1941 - DNA, 22 bp, Artificial Sequence
  Description of Artificial Sequence: Synthetic primer
catataacgcttccagactgct

SEQ ID NO: 1942 - DNA, 23 bp, Artificial Sequence
  Description of Artificial Sequence: Synthetic primer
tcaaacaacaaaccgcagaatcc

SEQ ID NO: 1943 - DNA, 22 bp, Artificial Sequence
  Description of Artificial Sequence: Synthetic primer
gcgagtatagatgccagtaagc

SEQ ID NO: 1944 - DNA, 23 bp, Artificial Sequence
  Description of Artificial Sequence: Synthetic primer
tcaaacaacaaaccgcagaaagt

SEQ ID NO: 1945 - DNA, 21 bp, Artificial Sequence
  Description of Artificial Sequence: Synthetic primer
atctgaccgatgacaatgcct

SEQ ID NO: 1946 - DNA, 23 bp, Artificial Sequence
  Description of Artificial Sequence: Synthetic primer
ccatcggttgttttcagaagcat

SEQ ID NO: 1947 - DNA, 21 bp, Artificial Sequence
  Description of Artificial Sequence: Synthetic primer
atctgaccgatgacaatgcca

SEQ ID NO: 1948 - DNA, 30 bp, Artificial Sequence
  Description of Artificial Sequence: Synthetic primer
cacgttaatttttagaagatcgcgaataag

SEQ ID NO: 1949 - DNA, 23 bp, Artificial Sequence
  Description of Artificial Sequence: Synthetic primer
agattgcgatgcttaatggttgc

SEQ ID NO: 1950 - DNA, 30 bp, Artificial Sequence
  Description of Artificial Sequence: Synthetic primer
cacgttaattttcaaaagatcgcgaatcaa

SEQ ID NO: 1951 - DNA, 21 bp, Artificial Sequence
  Description of Artificial Sequence: Synthetic primer
cttggacgaggaaaggcttga

SEQ ID NO: 1952 - DNA, 20 bp, Artificial Sequence
  Description of Artificial Sequence: Synthetic primer
ttcggcatgtgggaaagtca

SEQ ID NO: 1953 - DNA, 21 bp, Artificial Sequence
  Description of Artificial Sequence: Synthetic primer
cttggacgaggaaaggcttag

SEQ ID NO: 1954 - DNA, 21 bp, Artificial Sequence
  Description of Artificial Sequence: Synthetic primer
gacatcatcaccgtcgattct

SEQ ID NO: 1955 - DNA, 20 bp, Artificial Sequence
  Description of Artificial Sequence: Synthetic primer
ggtgccatgtgagcgatagt

SEQ ID NO: 1956 - DNA, 21 bp, Artificial Sequence
  Description of Artificial Sequence: Synthetic primer
gacatcatcaccgtcgatagc

SEQ ID NO: 1957 - DNA, 20 bp, Artificial Sequence
  Description of Artificial Sequence: Synthetic primer
ctaacccggacgatgactca

SEQ ID NO: 1958 - DNA, 19 bp, Artificial Sequence
  Description of Artificial Sequence: Synthetic primer
aaactccagccctttcgac

SEQ ID NO: 1959 - DNA, 20 bp, Artificial Sequence
  Description of Artificial Sequence: Synthetic primer
ctaacccggacgatgacagc

SEQ ID NO: 1960 - DNA, 24 bp, Artificial Sequence
  Description of Artificial Sequence: Synthetic primer
caggagccaaagatataacccagt

SEQ ID NO: 1961 - DNA, 31 bp, Artificial Sequence
  Description of Artificial Sequence: Synthetic primer
gtcttcgtggttatacttctgctaataattt

SEQ ID NO: 1962 - DNA, 24 bp, Artificial Sequence
  Description of Artificial Sequence: Synthetic primer
caggagccaaagatataacccagg

SEQ ID NO: 1963 - DNA, 28 bp, Artificial Sequence
  Description of Artificial Sequence: Synthetic primer
ctgaactacttttcctgatatgtcgctt

SEQ ID NO: 1964 - DNA, 20 bp, Artificial Sequence
  Description of Artificial Sequence: Synthetic primer
acaaaaaccagcgccatcag

SEQ ID NO: 1965 - DNA, 28 bp, Artificial Sequence
  Description of Artificial Sequence: Synthetic primer
ttgaactacttttcctgatatgtcgttg

SEQ ID NO: 1966 - DNA, 22 bp, Artificial Sequence
  Description of Artificial Sequence: Synthetic primer
cgtggctgtttttccttgtatc

SEQ ID NO: 1967 - DNA, 21 bp, Artificial Sequence
  Description of Artificial Sequence: Synthetic primer
ggtgtcgcgagtgagatagag

SEQ ID NO: 1968 - DNA, 22 bp, Artificial Sequence
  Description of Artificial Sequence: Synthetic primer
cgtggctgtttttcctcgtcag

SEQ ID NO: 1969 - DNA, 24 bp, Artificial Sequence
  Description of Artificial Sequence: Synthetic primer
accgttctgaatacatcaagcaac

SEQ ID NO: 1970 - DNA, 23 bp, Artificial Sequence
  Description of Artificial Sequence: Synthetic primer
tttgggtagttatcgaagtggca

SEQ ID NO: 1971 - DNA, 24 bp, Artificial Sequence
  Description of Artificial Sequence: Synthetic primer
accgttctgaatacatcaagcaat

SEQ ID NO: 1972 - DNA, 18 bp, Artificial Sequence
  Description of Artificial Sequence: Synthetic primer
gccagagtgcaagtggtg

SEQ ID NO: 1973 - DNA, 22 bp, Artificial Sequence
  Description of Artificial Sequence: Synthetic primer
atccactgccagacctcatttt

SEQ ID NO: 1974 - DNA, 18 bp, Artificial Sequence
  Description of Artificial Sequence: Synthetic primer
gccagagtgcaagtgggc

SEQ ID NO: 1975 - DNA, 27 bp, Artificial Sequence
  Description of Artificial Sequence: Synthetic primer
gtcgattagttccataaatcgctgaag

SEQ ID NO: 1976 - DNA, 24 bp, Artificial Sequence
  Description of Artificial Sequence: Synthetic primer
ggataccaacaacattcagtacgc

SEQ ID NO: 1977 - DNA, 27 bp, Artificial Sequence
  Description of Artificial Sequence: Synthetic primer
gtcgattaattccataaatcgctgcaa

SEQ ID NO: 1978 - DNA, 31 bp, Artificial Sequence
  Description of Artificial Sequence: Synthetic primer
gcttgcagatgaaattgaaaatatctattct

SEQ ID NO: 1979 - DNA, 29 bp, Artificial Sequence
  Description of Artificial Sequence: Synthetic primer
aacaaatggttctatgagaaagaggtaaa

SEQ ID NO: 1980 - DNA, 31 bp, Artificial Sequence
  Description of Artificial Sequence: Synthetic primer
gttggcagatgaaattgaaaatatctatagc

SEQ ID NO: 1981 - DNA, 25 bp, Artificial Sequence
  Description of Artificial Sequence: Synthetic primer
ttccagacaggtaagggtagagaat

SEQ ID NO: 1982 - DNA, 19 bp, Artificial Sequence
  Description of Artificial Sequence: Synthetic primer
cgcttctttctcccgacca

SEQ ID NO: 1983 - DNA, 25 bp, Artificial Sequence
  Description of Artificial Sequence: Synthetic primer
ttccagacaggttaaggtagagaaa

SEQ ID NO: 1984 - DNA, 21 bp, Artificial Sequence
  Description of Artificial Sequence: Synthetic primer
cacttttgctaccagacctga

SEQ ID NO: 1985 - DNA, 23 bp, Artificial Sequence
  Description of Artificial Sequence: Synthetic primer
ccgattcaggcaatgtgatttgt

SEQ ID NO: 1986 - DNA, 21 bp, Artificial Sequence
  Description of Artificial Sequence: Synthetic primer
cacttttgctaccagaccgct

SEQ ID NO: 1987 - DNA, 22 bp, Artificial Sequence
  Description of Artificial Sequence: Synthetic primer
gggcaagtatctacagcactca

SEQ ID NO: 1988 - DNA, 26 bp, Artificial Sequence
  Description of Artificial Sequence: Synthetic primer
gcaataattagtagctgccaaatgga

SEQ ID NO: 1989 - DNA, 22 bp, Artificial Sequence
  Description of Artificial Sequence: Synthetic primer
gggcaagtatttacagcacagt

SEQ ID NO: 1990 - DNA, 19 bp, Artificial Sequence
  Description of Artificial Sequence: Synthetic primer
gcccaggaacacctcgaac

SEQ ID NO: 1991 - DNA, 20 bp, Artificial Sequence
  Description of Artificial Sequence: Synthetic primer
gttgccggatcgacaatgtc

SEQ ID NO: 1992 - DNA, 19 bp, Artificial Sequence
  Description of Artificial Sequence: Synthetic primer
gcccaggaacacctcgaaa

SEQ ID NO: 1993 - DNA, 25 bp, Artificial Sequence
  Description of Artificial Sequence: Synthetic primer
ttttcacgtggttcactacaacttc

SEQ ID NO: 1994 - DNA, 24 bp, Artificial Sequence
  Description of Artificial Sequence: Synthetic primer
acaaaaaaggtctgggtaaaagcg

SEQ ID NO: 1995 - DNA, 25 bp, Artificial Sequence
  Description of Artificial Sequence: Synthetic primer
tttagccgtggttcattgcaattgt

SEQ ID NO: 1996 - DNA, 23 bp, Artificial Sequence
  Description of Artificial Sequence: Synthetic primer
agctttgaggtatccattcgtga

SEQ ID NO: 1997 - DNA, 25 bp, Artificial Sequence
  Description of Artificial Sequence: Synthetic primer
tatggatgttgataagccaggcaaa

SEQ ID NO: 1998 - DNA, 23 bp, Artificial Sequence
  Description of Artificial Sequence: Synthetic primer
agctttgaggtatccattcgact

SEQ ID NO: 1999 - DNA, 28 bp, Artificial Sequence
  Description of Artificial Sequence: Synthetic primer
ccagtttacttttaatggtgatggttca

SEQ ID NO: 2000 - DNA, 22 bp, Artificial Sequence
  Description of Artificial Sequence: Synthetic primer
tttccgcatccattccttcaga

SEQ ID NO: 2001 - DNA, 28 bp, Artificial Sequence
  Description of Artificial Sequence: Synthetic primer
ccagtttacttttaatggtgatggtagt

SEQ ID NO: 2002 - DNA, 24 bp, Artificial Sequence
  Description of Artificial Sequence: Synthetic primer
cttgtccacgccttgtttctttag

SEQ ID NO: 2003 - DNA, 26 bp, Artificial Sequence
  Description of Artificial Sequence: Synthetic primer
aaatccgccttttattatggttcagg

SEQ ID NO: 2004 - DNA, 24 bp, Artificial Sequence
  Description of Artificial Sequence: Synthetic primer
cttgtccacgccttgtttcttcaa

SEQ ID NO: 2005 - DNA, 25 bp, Artificial Sequence
  Description of Artificial Sequence: Synthetic primer
cagatcctcaactcgctgattaact

SEQ ID NO: 2006 - DNA, 20 bp, Artificial Sequence
  Description of Artificial Sequence: Synthetic primer
agacggtcgaccagatttcg

SEQ ID NO: 2007 - DNA, 25 bp, Artificial Sequence
  Description of Artificial Sequence: Synthetic primer
cagatcctcaactcgctgattaaca

SEQ ID NO: 2008 - DNA, 25 bp, Artificial Sequence
  Description of Artificial Sequence: Synthetic primer
cgagcagcatgaagatcttaaatca

SEQ ID NO: 2009 - DNA, 25 bp, Artificial Sequence
  Description of Artificial Sequence: Synthetic primer
tgattttctggaagtggtgtttcag

SEQ ID NO: 2010 - DNA, 25 bp, Artificial Sequence
  Description of Artificial Sequence: Synthetic primer
cgagcagcatgaagatttaaaaagt

SEQ ID NO: 2011 - DNA, 22 bp, Artificial Sequence
  Description of Artificial Sequence: Synthetic primer
gatcttccgttgtgatgtggga

SEQ ID NO: 2012 - DNA, 24 bp, Artificial Sequence
  Description of Artificial Sequence: Synthetic primer
cgcacacttacaccctgaaatatc

SEQ ID NO: 2013 - DNA, 22 bp, Artificial Sequence
  Description of Artificial Sequence: Synthetic primer
gatcttccgttgtgatgtgact

SEQ ID NO: 2014 - DNA, 21 bp, Artificial Sequence
  Description of Artificial Sequence: Synthetic primer
cctggccaaacaaagtcctct

SEQ ID NO: 2015 - DNA, 31 bp, Artificial Sequence
  Description of Artificial Sequence: Synthetic primer
attcattcatttattcctttatccagtcgtt

SEQ ID NO: 2016 - DNA, 21 bp, Artificial Sequence
  Description of Artificial Sequence: Synthetic primer
cctggccaaacaaagtcctca

SEQ ID NO: 2017 - DNA, 22 bp, Artificial Sequence
  Description of Artificial Sequence: Synthetic primer
cgaaatctttggcgacgaaact

SEQ ID NO: 2018 - DNA, 28 bp, Artificial Sequence
  Description of Artificial Sequence: Synthetic primer
gtatggagccaacgaagaataaaaattt

SEQ ID NO: 2019 - DNA, 22 bp, Artificial Sequence
  Description of Artificial Sequence: Synthetic primer
cgaaatctttggcgacgagacg

SEQ ID NO: 2020 - DNA, 18 bp, Artificial Sequence
  Description of Artificial Sequence: Synthetic primer
gcgacggcggaaaattca

SEQ ID NO: 2021 - DNA, 22 bp, Artificial Sequence
  Description of Artificial Sequence: Synthetic primer
tcgacagacaaccgatcacttt

SEQ ID NO: 2022 - DNA, 18 bp, Artificial Sequence
  Description of Artificial Sequence: Synthetic primer
gcgacggcggaaaatagc

SEQ ID NO: 2023 - DNA, 24 bp, Artificial Sequence
  Description of Artificial Sequence: Synthetic primer
gttatcaccaagaaacagacctga

SEQ ID NO: 2024 - DNA, 20 bp, Artificial Sequence
  Description of Artificial Sequence: Synthetic primer
cggagaaagtcaacgcgttt

SEQ ID NO: 2025 - DNA, 24 bp, Artificial Sequence
  Description of Artificial Sequence: Synthetic primer
gttatcaccaagaaacagaccgct

SEQ ID NO: 2026 - DNA, 22 bp, Artificial Sequence
  Description of Artificial Sequence: Synthetic primer
aaaagcgtcgaaaagtggttgg

SEQ ID NO: 2027 - DNA, 19 bp, Artificial Sequence
  Description of Artificial Sequence: Synthetic primer
gcagccctataccatcacc

SEQ ID NO: 2028 - DNA, 22 bp, Artificial Sequence
  Description of Artificial Sequence: Synthetic primer
aaaagcgtcgaaaagtggttac

SEQ ID NO: 2029 - DNA, 27 bp, Artificial Sequence
  Description of Artificial Sequence: Synthetic primer
ccgacaatactggagatgaatatgtct

SEQ ID NO: 2030 - DNA, 21 bp, Artificial Sequence
  Description of Artificial Sequence: Synthetic primer
ccacacatccaggcccataat

SEQ ID NO: 2031 - DNA, 27 bp, Artificial Sequence
  Description of Artificial Sequence: Synthetic primer
ccgacaatactggagatgaatatgagc

SEQ ID NO: 2032 - DNA, 24 bp, Artificial Sequence
  Description of Artificial Sequence: Synthetic primer
ggttcggcactattcctgtttcta

SEQ ID NO: 2033 - DNA, 18 bp, Artificial Sequence
  Description of Artificial Sequence: Synthetic primer
cgtgagcgcctgaaacac

SEQ ID NO: 2034 - DNA, 24 bp, Artificial Sequence
  Description of Artificial Sequence: Synthetic primer
ggttcggcactattcctgtttttg

SEQ ID NO: 2035 - DNA, 25 bp, Artificial Sequence
  Description of Artificial Sequence: Synthetic primer
cttcacatcctgagtatccttaccg

SEQ ID NO: 2036 - DNA, 20 bp, Artificial Sequence
  Description of Artificial Sequence: Synthetic primer
gcttttctcactggcgggta

SEQ ID NO: 2037 - DNA, 25 bp, Artificial Sequence
  Description of Artificial Sequence: Synthetic primer
cttcacatcctgagtatctttacca

SEQ ID NO: 2038 - DNA, 24 bp, Artificial Sequence
  Description of Artificial Sequence: Synthetic primer
acccacaccgaagaaaatgagtag

SEQ ID NO: 2039 - DNA, 27 bp, Artificial Sequence
  Description of Artificial Sequence: Synthetic primer
gcgaatgatctaacaaacatgcatcat

SEQ ID NO: 2040 - DNA, 24 bp, Artificial Sequence
  Description of Artificial Sequence: Synthetic primer
acccacaccgaagaaaatcaacaa

SEQ ID NO: 2041 - DNA, 31 bp, Artificial Sequence
  Description of Artificial Sequence: Synthetic primer
caaaatcagcaggaaaaaacctttatcgatc

SEQ ID NO: 2042 - DNA, 30 bp, Artificial Sequence
  Description of Artificial Sequence: Synthetic primer
cccttgctcatatagataatttactgcatc

SEQ ID NO: 2043 - DNA, 31 bp, Artificial Sequence
  Description of Artificial Sequence: Synthetic primer
caaaatcagcaggaaaaaacctttatcgatt

SEQ ID NO: 2044 - DNA, 27 bp, Artificial Sequence
  Description of Artificial Sequence: Synthetic primer
gtagaatcaccatctaatccactcctt

SEQ ID NO: 2045 - DNA, 23 bp, Artificial Sequence
  Description of Artificial Sequence: Synthetic primer
gaccgttcagatatttcgtgcat

SEQ ID NO: 2046 - DNA, 27 bp, Artificial Sequence
  Description of Artificial Sequence: Synthetic primer
gtagaaagcccaagtaatccattgtta

SEQ ID NO: 2047 - DNA, 25 bp, Artificial Sequence
  Description of Artificial Sequence: Synthetic primer
cagtaggttcacgaagaagtcattt

SEQ ID NO: 2048 - DNA, 20 bp, Artificial Sequence
  Description of Artificial Sequence: Synthetic primer
gtgcctggttcaaactgacg

SEQ ID NO: 2049 - DNA, 25 bp, Artificial Sequence
  Description of Artificial Sequence: Synthetic primer
cagcaagttcacgaagaagtcattg

SEQ ID NO: 2050 - DNA, 25 bp, Artificial Sequence
  Description of Artificial Sequence: Synthetic primer
tcatcgggatcatgattttcagtga

SEQ ID NO: 2051 - DNA, 19 bp, Artificial Sequence
  Description of Artificial Sequence: Synthetic primer
gcaccacctcacatacggt

SEQ ID NO: 2052 - DNA, 25 bp, Artificial Sequence
  Description of Artificial Sequence: Synthetic primer
tcatcgggatcatgattttcaggct

SEQ ID NO: 2053 - DNA, 25 bp, Artificial Sequence
  Description of Artificial Sequence: Synthetic primer
cctgagtcgcgtccataattttaag

SEQ ID NO: 2054 - DNA, 22 bp, Artificial Sequence
  Description of Artificial Sequence: Synthetic primer
cgcatctcatgtaacgttgtgg

SEQ ID NO: 2055 - DNA, 25 bp, Artificial Sequence
  Description of Artificial Sequence: Synthetic primer
cctgagtcgcgtccataatttttaa

SEQ ID NO: 2056 - DNA, 19 bp, Artificial Sequence
  Description of Artificial Sequence: Synthetic primer
gcttcggtatgacgcgttg

SEQ ID NO: 2057 - DNA, 21 bp, Artificial Sequence
  Description of Artificial Sequence: Synthetic primer
ctgctactctctcgctggaaa

SEQ ID NO: 2058 - DNA, 19 bp, Artificial Sequence
  Description of Artificial Sequence: Synthetic primer
gcttcggtatgacgcgtgc

SEQ ID NO: 2059 - DNA, 23 bp, Artificial Sequence
  Description of Artificial Sequence: Synthetic primer
catgatgatgacgctgaaaggac

SEQ ID NO: 2060 - DNA, 24 bp, Artificial Sequence
  Description of Artificial Sequence: Synthetic primer
cacctgtgagaatttctgaagctc

SEQ ID NO: 2061 - DNA, 23 bp, Artificial Sequence
  Description of Artificial Sequence: Synthetic primer
catgatgatgacgctgaaaggtt

SEQ ID NO: 2062 - DNA, 24 bp, Artificial Sequence
  Description of Artificial Sequence: Synthetic primer
aagacgtaccactttttcggcaag

SEQ ID NO: 2063 - DNA, 23 bp, Artificial Sequence
  Description of Artificial Sequence: Synthetic primer
caatcatcgcacctttccttacc

SEQ ID NO: 2064 - DNA, 24 bp, Artificial Sequence
  Description of Artificial Sequence: Synthetic primer
caaacgtaccactttttcggctaa

SEQ ID NO: 2065 - DNA, 24 bp, Artificial Sequence
  Description of Artificial Sequence: Synthetic primer
agtcaggagtatttagccttggac

SEQ ID NO: 2066 - DNA, 19 bp, Artificial Sequence
  Description of Artificial Sequence: Synthetic primer
cgagattcccccagtagcg

SEQ ID NO: 2067 - DNA, 24 bp, Artificial Sequence
  Description of Artificial Sequence: Synthetic primer
agtcaggagtatttagccttggag

SEQ ID NO: 2068 - DNA, 29 bp, Artificial Sequence
  Description of Artificial Sequence: Synthetic primer
taatccatcccagactgaaggacatttag

SEQ ID NO: 2069 - DNA, 24 bp, Artificial Sequence
  Description of Artificial Sequence: Synthetic primer
ctggtgaagtttgtttccgatctc

SEQ ID NO: 2070 - DNA, 29 bp, Artificial Sequence
  Description of Artificial Sequence: Synthetic primer
taatccatcccgctctgtaagacatttaa

SEQ ID NO: 2071 - DNA, 19 bp, Artificial Sequence
  Description of Artificial Sequence: Synthetic primer
agcgaacatggagctgtca

SEQ ID NO: 2072 - DNA, 18 bp, Artificial Sequence
  Description of Artificial Sequence: Synthetic primer
gagtcgggtgcacatccc

SEQ ID NO: 2073 - DNA, 19 bp, Artificial Sequence
  Description of Artificial Sequence: Synthetic primer
agcgaacatggagctgagc

SEQ ID NO: 2074 - DNA, 23 bp, Artificial Sequence
  Description of Artificial Sequence: Synthetic primer
gccagaatccttcaacgtacttc

SEQ ID NO: 2075 - DNA, 20 bp, Artificial Sequence
  Description of Artificial Sequence: Synthetic primer
tcaggatctgctgacgttcc

SEQ ID NO: 2076 - DNA, 23 bp, Artificial Sequence
  Description of Artificial Sequence: Synthetic primer
gccagaatccttcaacgtattgt

SEQ ID NO: 2077 - DNA, 20 bp, Artificial Sequence
  Description of Artificial Sequence: Synthetic primer
gcgcagatggtttgcacaag

SEQ ID NO: 2078 - DNA, 19 bp, Artificial Sequence
  Description of Artificial Sequence: Synthetic primer
cccgtgaatcagccgctat

SEQ ID NO: 2079 - DNA, 20 bp, Artificial Sequence
  Description of Artificial Sequence: Synthetic primer
gcgcagatggtttgcactaa

SEQ ID NO: 2080 - DNA, 20 bp, Artificial Sequence
  Description of Artificial Sequence: Synthetic primer
catcgcccattcggttttgg

SEQ ID NO: 2081 - DNA, 25 bp, Artificial Sequence
  Description of Artificial Sequence: Synthetic primer
ttgactccgcaagtttgtattcaaa

SEQ ID NO: 2082 - DNA, 20 bp, Artificial Sequence
  Description of Artificial Sequence: Synthetic primer
catcgcccattcggttttgc

SEQ ID NO: 2083 - DNA, 25 bp, Artificial Sequence
  Description of Artificial Sequence: Synthetic primer
tatttttatcgccgttgatgcctca

SEQ ID NO: 2084 - DNA, 22 bp, Artificial Sequence
  Description of Artificial Sequence: Synthetic primer
cctctttcgccataacttgtgc

SEQ ID NO: 2085 - DNA, 25 bp, Artificial Sequence
  Description of Artificial Sequence: Synthetic primer
tatttttatcgccgttgatgccagt

SEQ ID NO: 2086 - DNA, 23 bp, Artificial Sequence
  Description of Artificial Sequence: Synthetic primer
gataccggctttgtcagaaactg

SEQ ID NO: 2087 - DNA, 26 bp, Artificial Sequence
  Description of Artificial Sequence: Synthetic primer
gcacagagttatccacaatcatcaat

SEQ ID NO: 2088 - DNA, 23 bp, Artificial Sequence
  Description of Artificial Sequence: Synthetic primer
gataccggctttgtcagaaacac

SEQ ID NO: 2089 - DNA, 21 bp, Artificial Sequence
  Description of Artificial Sequence: Synthetic primer
ctcattaaccgcgacccaaag

SEQ ID NO: 2090 - DNA, 31 bp, Artificial Sequence
  Description of Artificial Sequence: Synthetic primer
tcaaggaaaagactacgttagaatataagaa

SEQ ID NO: 2091 - DNA, 21 bp, Artificial Sequence
  Description of Artificial Sequence: Synthetic primer
ctcattaaccgcgacccacaa

SEQ ID NO: 2092 - DNA, 23 bp, Artificial Sequence
  Description of Artificial Sequence: Synthetic primer
tttccccggcacttatggaactt

SEQ ID NO: 2093 - DNA, 19 bp, Artificial Sequence
  Description of Artificial Sequence: Synthetic primer
tcttcaatggcgtcgcgaa

SEQ ID NO: 2094 - DNA, 23 bp, Artificial Sequence
  Description of Artificial Sequence: Synthetic primer
tttccccggcattaatggaatta

SEQ ID NO: 2095 - DNA, 25 bp, Artificial Sequence
  Description of Artificial Sequence: Synthetic primer
ctttatccatcacgcgaaacttctt

SEQ ID NO: 2096 - DNA, 18 bp, Artificial Sequence
  Description of Artificial Sequence: Synthetic primer
gccgaccacattcatgcc

SEQ ID NO: 2097 - DNA, 25 bp, Artificial Sequence
  Description of Artificial Sequence: Synthetic primer
ctttatccatcacgcgaaattgttg

SEQ ID NO: 2098 - DNA, 21 bp, Artificial Sequence
  Description of Artificial Sequence: Synthetic primer
gagtttattcgcggcatgtca

SEQ ID NO: 2099 - DNA, 20 bp, Artificial Sequence
  Description of Artificial Sequence: Synthetic primer
gcgtcattttcctggtcagc

SEQ ID NO: 2100 - DNA, 21 bp, Artificial Sequence
  Description of Artificial Sequence: Synthetic primer
gagtttattcgcggcatgagt

SEQ ID NO: 2101 - DNA, 19 bp, Artificial Sequence
  Description of Artificial Sequence: Synthetic primer
tagcgttttggcctcggaa

SEQ ID NO: 2102 - DNA, 25 bp, Artificial Sequence
  Description of Artificial Sequence: Synthetic primer
caacaaaaatgggtcactcaggatc

SEQ ID NO: 2103 - DNA, 19 bp, Artificial Sequence
  Description of Artificial Sequence: Synthetic primer
tagcgttttggcctcactg

SEQ ID NO: 2104 - DNA, 25 bp, Artificial Sequence
  Description of Artificial Sequence: Synthetic primer
acatctttaacctttcactcctcca

SEQ ID NO: 2105 - DNA, 22 bp, Artificial Sequence
  Description of Artificial Sequence: Synthetic primer
cgtaattttcgcgtatctgggt

SEQ ID NO: 2106 - DNA, 25 bp, Artificial Sequence
  Description of Artificial Sequence: Synthetic primer
acatctttaacctttcacaccacct

SEQ ID NO: 2107 - DNA, 25 bp, Artificial Sequence
  Description of Artificial Sequence: Synthetic primer
acttgttaaagcccttcaggactga

SEQ ID NO: 2108 - DNA, 23 bp, Artificial Sequence
  Description of Artificial Sequence: Synthetic primer
ctgggatatttctggtcctggtg

SEQ ID NO: 2109 - DNA, 25 bp, Artificial Sequence
  Description of Artificial Sequence: Synthetic primer
acttgttaaagcccttcaggacact

SEQ ID NO: 2110 - DNA, 18 bp, Artificial Sequence
  Description of Artificial Sequence: Synthetic primer
acatctcccgcgacgtac

SEQ ID NO: 2111 - DNA, 19 bp, Artificial Sequence
  Description of Artificial Sequence: Synthetic primer
gacgggttggcggaaagta

SEQ ID NO: 2112 - DNA, 18 bp, Artificial Sequence
  Description of Artificial Sequence: Synthetic primer
acatctcccgcgacgtat

SEQ ID NO: 2113 - DNA, 29 bp, Artificial Sequence
  Description of Artificial Sequence: Synthetic primer
tacaggtatgcgtttaaacccagttaaac

SEQ ID NO: 2114 - DNA, 24 bp, Artificial Sequence
  Description of Artificial Sequence: Synthetic primer
ctcaaagtgggggttaagaatgtc

SEQ ID NO: 2115 - DNA, 29 bp, Artificial Sequence
  Description of Artificial Sequence: Synthetic primer
tacaggtatgcgtttaaacccagttaaat

SEQ ID NO: 2116 - DNA, 24 bp, Artificial Sequence
  Description of Artificial Sequence: Synthetic primer
agaagcagtacaggtttggtgata

SEQ ID NO: 2117 - DNA, 19 bp, Artificial Sequence
  Description of Artificial Sequence: Synthetic primer
gcccctgcctcaaaaatgg

SEQ ID NO: 2118 - DNA, 24 bp, Artificial Sequence
  Description of Artificial Sequence: Synthetic primer
agtaacagtacaggtttggtgatt

SEQ ID NO: 2119 - DNA, 23 bp, Artificial Sequence
  Description of Artificial Sequence: Synthetic primer
catctgaataaagcgcactggtc

SEQ ID NO: 2120 - DNA, 18 bp, Artificial Sequence
  Description of Artificial Sequence: Synthetic primer
cgtgcgaccagtgcaaag

SEQ ID NO: 2121 - DNA, 23 bp, Artificial Sequence
  Description of Artificial Sequence: Synthetic primer
catctgaataaagcgcactggag

SEQ ID NO: 2122 - DNA, 20 bp, Artificial Sequence
  Description of Artificial Sequence: Synthetic primer
tgaccacccacaaaacctca

SEQ ID NO: 2123 - DNA, 27 bp, Artificial Sequence
  Description of Artificial Sequence: Synthetic primer
ggaattatactccccaacagatgaatt

SEQ ID NO: 2124 - DNA, 20 bp, Artificial Sequence
  Description of Artificial Sequence: Synthetic primer
tgaccacccacaaaaccagt

SEQ ID NO: 2125 - DNA, 27 bp, Artificial Sequence
  Description of Artificial Sequence: Synthetic primer
gtcacatcaccatcacatacaaagaag

SEQ ID NO: 2126 - DNA, 25 bp, Artificial Sequence
  Description of Artificial Sequence: Synthetic primer
ttttccatgatggcgaagttgaaat

SEQ ID NO: 2127 - DNA, 27 bp, Artificial Sequence
  Description of Artificial Sequence: Synthetic primer
gtcacaagtccatcacatacaaagaaa

SEQ ID NO: 2128 - DNA, 22 bp, Artificial Sequence
  Description of Artificial Sequence: Synthetic primer
gatcgtgcaaaaggttctgtct

SEQ ID NO: 2129 - DNA, 18 bp, Artificial Sequence
  Description of Artificial Sequence: Synthetic primer
gcgacaccaagccagaac

SEQ ID NO: 2130 - DNA, 22 bp, Artificial Sequence
  Description of Artificial Sequence: Synthetic primer
gatcgtgcaaaaggttctgagc

SEQ ID NO: 2131 - DNA, 27 bp, Artificial Sequence
  Description of Artificial Sequence: Synthetic primer
tactatctgtggcaaaacgattactca

SEQ ID NO: 2132 - DNA, 24 bp, Artificial Sequence
  Description of Artificial Sequence: Synthetic primer
tcgccatattaatcgactcaacca

SEQ ID NO: 2133 - DNA, 27 bp, Artificial Sequence
  Description of Artificial Sequence: Synthetic primer
tactatctgtggcaaaacgattacagc

SEQ ID NO: 2134 - DNA, 20 bp, Artificial Sequence
  Description of Artificial Sequence: Synthetic primer
gcgagaatctctgcgtgcac

SEQ ID NO: 2135 - DNA, 28 bp, Artificial Sequence
  Description of Artificial Sequence: Synthetic primer
gtttttttgaatagggtatgcagatgga

SEQ ID NO: 2136 - DNA, 20 bp, Artificial Sequence
  Description of Artificial Sequence: Synthetic primer
gcgagaatctctgcgtgcat

SEQ ID NO: 2137 - DNA, 26 bp, Artificial Sequence
  Description of Artificial Sequence: Synthetic primer
cagtaagcgcaataacaatacgtgaa

SEQ ID NO: 2138 - DNA, 24 bp, Artificial Sequence
  Description of Artificial Sequence: Synthetic primer
tgtaattttccctcttcagcacga

SEQ ID NO: 2139 - DNA, 26 bp, Artificial Sequence
  Description of Artificial Sequence: Synthetic primer
cagttaacgcaataacaatcctgctc

SEQ ID NO: 2140 - DNA, 23 bp, Artificial Sequence
  Description of Artificial Sequence: Synthetic primer
caccgaagccttcaaaaaagcat

SEQ ID NO: 2141 - DNA, 19 bp, Artificial Sequence
  Description of Artificial Sequence: Synthetic primer
caacacccattgccatcgt

SEQ ID NO: 2142 - DNA, 23 bp, Artificial Sequence
  Description of Artificial Sequence: Synthetic primer
caccgaagccttcaaaaaagcaa

SEQ ID NO: 2143 - DNA, 26 bp, Artificial Sequence
  Description of Artificial Sequence: Synthetic primer
gggcgatatcttcatacagttttact

SEQ ID NO: 2144 - DNA, 20 bp, Artificial Sequence
  Description of Artificial Sequence: Synthetic primer
ctggtgttcggcatgtctga

SEQ ID NO: 2145 - DNA, 26 bp, Artificial Sequence
  Description of Artificial Sequence: Synthetic primer
gggcgatatcttcatacagtttcacc

SEQ ID NO: 2146 - DNA, 24 bp, Artificial Sequence
  Description of Artificial Sequence: Synthetic primer
ctcttgatagcgtgttgggtatga

SEQ ID NO: 2147 - DNA, 18 bp, Artificial Sequence
  Description of Artificial Sequence: Synthetic primer
ctggcggtggttctctcc

SEQ ID NO: 2148 - DNA, 24 bp, Artificial Sequence
  Description of Artificial Sequence: Synthetic primer
ctcttgatagcgtgttgggtagct

SEQ ID NO: 2149 - DNA, 19 bp, Artificial Sequence
  Description of Artificial Sequence: Synthetic primer
ggcgcagaacaccatctca

SEQ ID NO: 2150 - DNA, 21 bp, Artificial Sequence
  Description of Artificial Sequence: Synthetic primer
cattttgttgacgcagagcca

SEQ ID NO: 2151 - DNA, 19 bp, Artificial Sequence
  Description of Artificial Sequence: Synthetic primer
ggcgcagaacaccatcagt

SEQ ID NO: 2152 - DNA, 30 bp, Artificial Sequence
  Description of Artificial Sequence: Synthetic primer
tgtgtatctgactcggtttaccaaataata

SEQ ID NO: 2153 - DNA, 23 bp, Artificial Sequence
  Description of Artificial Sequence: Synthetic primer
cgtcatatcatacgcctgcattc

SEQ ID NO: 2154 - DNA, 30 bp, Artificial Sequence
  Description of Artificial Sequence: Synthetic primer
tgtgtaagtgacagcgtttatcaaattatt

SEQ ID NO: 2155 - DNA, 20 bp, Artificial Sequence
  Description of Artificial Sequence: Synthetic primer
gctttttcccgatcgcctag

SEQ ID NO: 2156 - DNA, 24 bp, Artificial Sequence
  Description of Artificial Sequence: Synthetic primer
attccttcataaccgggtaagcaa

SEQ ID NO: 2157 - DNA, 20 bp, Artificial Sequence
  Description of Artificial Sequence: Synthetic primer
gctttttcccgatcgcccaa

SEQ ID NO: 2158 - DNA, 22 bp, Artificial Sequence
  Description of Artificial Sequence: Synthetic primer
caatacccggtatccactcgtc

SEQ ID NO: 2159 - DNA, 22 bp, Artificial Sequence
  Description of Artificial Sequence: Synthetic primer
gttacctttcgccagcatgatc

SEQ ID NO: 2160 - DNA, 22 bp, Artificial Sequence
  Description of Artificial Sequence: Synthetic primer
caatacccggtatccactcgtt

SEQ ID NO: 2161 - DNA, 19 bp, Artificial Sequence
  Description of Artificial Sequence: Synthetic primer
ccgagaacagtaccgcaga

SEQ ID NO: 2162 - DNA, 21 bp, Artificial Sequence
  Description of Artificial Sequence: Synthetic primer
ccccggaatcttcatacagca

SEQ ID NO: 2163 - DNA, 19 bp, Artificial Sequence
  Description of Artificial Sequence: Synthetic primer
ccgagaacagtaccgcact

SEQ ID NO: 2164 - DNA, 21 bp, Artificial Sequence
  Description of Artificial Sequence: Synthetic primer
ccagccatcagattccgtacg

SEQ ID NO: 2165 - DNA, 18 bp, Artificial Sequence
  Description of Artificial Sequence: Synthetic primer
gcacaccaccacttctcc

SEQ ID NO: 2166 - DNA, 21 bp, Artificial Sequence
  Description of Artificial Sequence: Synthetic primer
ccagccatcagattccgttct

SEQ ID NO: 2167 - DNA, 29 bp, Artificial Sequence
  Description of Artificial Sequence: Synthetic primer
ctgtaaagagtttgagaaatacaccttct

SEQ ID NO: 2168 - DNA, 19 bp, Artificial Sequence
  Description of Artificial Sequence: Synthetic primer
ttgctaccatcgccggatc

SEQ ID NO: 2169 - DNA, 29 bp, Artificial Sequence
  Description of Artificial Sequence: Synthetic primer
ctgtaaagagtttgagaaatacaccttca

SEQ ID NO: 2170 - DNA, 29 bp, Artificial Sequence
  Description of Artificial Sequence: Synthetic primer
tcaggaatatctgagattttgttgtttga

SEQ ID NO: 2171 - DNA, 24 bp, Artificial Sequence
  Description of Artificial Sequence: Synthetic primer
cgtaccagtgacataccgataact

SEQ ID NO: 2172 - DNA, 29 bp, Artificial Sequence
  Description of Artificial Sequence: Synthetic primer
tcaggaatatcactgattttgttgttgct

SEQ ID NO: 2173 - DNA, 23 bp, Artificial Sequence
  Description of Artificial Sequence: Synthetic primer
cctgaaaattgttctttgcctga

SEQ ID NO: 2174 - DNA, 18 bp, Artificial Sequence
  Description of Artificial Sequence: Synthetic primer
atggaactgcgcgacctg

SEQ ID NO: 2175 - DNA, 23 bp, Artificial Sequence
  Description of Artificial Sequence: Synthetic primer
ccgctaaattgttctttgccact

SEQ ID NO: 2176 - DNA, 19 bp, Artificial Sequence
  Description of Artificial Sequence: Synthetic primer
cagttaccgcccagagtga

SEQ ID NO: 2177 - DNA, 25 bp, Artificial Sequence
  Description of Artificial Sequence: Synthetic primer
cagggcaaagtagaatcatcgaaag

SEQ ID NO: 2178 - DNA, 19 bp, Artificial Sequence
  Description of Artificial Sequence: Synthetic primer
cagttaccgcccagagact

SEQ ID NO: 2179 - DNA, 19 bp, Artificial Sequence
  Description of Artificial Sequence: Synthetic primer
acgtcaggatctcgaccgt

SEQ ID NO: 2180 - DNA, 20 bp, Artificial Sequence
  Description of Artificial Sequence: Synthetic primer
cgcgaggtgtcatccataac

SEQ ID NO: 2181 - DNA, 19 bp, Artificial Sequence
  Description of Artificial Sequence: Synthetic primer
acgtcaggatctcgacaga

SEQ ID NO: 2182 - DNA, 22 bp, Artificial Sequence
  Description of Artificial Sequence: Synthetic primer
cgcaatatcggttatcgcgtac

SEQ ID NO: 2183 - DNA, 21 bp, Artificial Sequence
  Description of Artificial Sequence: Synthetic primer
cctggggagtcaatcacatca

SEQ ID NO: 2184 - DNA, 22 bp, Artificial Sequence
  Description of Artificial Sequence: Synthetic primer
cgcaatatcggttatcgcgtat

SEQ ID NO: 2185 - DNA, 27 bp, Artificial Sequence
  Description of Artificial Sequence: Synthetic primer
tattggcgatcctgattatgcgttttc

SEQ ID NO: 2186 - DNA, 23 bp, Artificial Sequence
  Description of Artificial Sequence: Synthetic primer
cagtgtaattcgagccattctgc

SEQ ID NO: 2187 - DNA, 27 bp, Artificial Sequence
  Description of Artificial Sequence: Synthetic primer
tattggcgatcctgattatgcgtttag

SEQ ID NO: 2188 - DNA, 20 bp, Artificial Sequence
  Description of Artificial Sequence: Synthetic primer
ggcatacgaacttgcagaga

SEQ ID NO: 2189 - DNA, 21 bp, Artificial Sequence
  Description of Artificial Sequence: Synthetic primer
gctttttcaggctctaacgga

SEQ ID NO: 2190 - DNA, 20 bp, Artificial Sequence
  Description of Artificial Sequence: Synthetic primer
ggcatacgaacttgcagact

SEQ ID NO: 2191 - DNA, 21 bp, Artificial Sequence
  Description of Artificial Sequence: Synthetic primer
gttgacggacgcacatagtat

SEQ ID NO: 2192 - DNA, 21 bp, Artificial Sequence
  Description of Artificial Sequence: Synthetic primer
aactggtcttcactcgtcgtc

SEQ ID NO: 2193 - DNA, 21 bp, Artificial Sequence
  Description of Artificial Sequence: Synthetic primer
gttgacggacgcacatagtag

SEQ ID NO: 2194 - DNA, 28 bp, Artificial Sequence
  Description of Artificial Sequence: Synthetic primer
cgtacttaaaggttgttcagattcttct

SEQ ID NO: 2195 - DNA, 21 bp, Artificial Sequence
  Description of Artificial Sequence: Synthetic primer
cgcagagtaaaacggtaagcc

SEQ ID NO: 2196 - DNA, 28 bp, Artificial Sequence
  Description of Artificial Sequence: Synthetic primer
cgtattgaaaggttgtagcgatagtagc

SEQ ID NO: 2197 - DNA, 27 bp, Artificial Sequence
  Description of Artificial Sequence: Synthetic primer
agtacaacaaatctcagtccatcactc

SEQ ID NO: 2198 - DNA, 23 bp, Artificial Sequence
  Description of Artificial Sequence: Synthetic primer
acaactttcagaccgacctctac

SEQ ID NO: 2199 - DNA, 27 bp, Artificial Sequence
  Description of Artificial Sequence: Synthetic primer
agtacaacaaaagtcagtccatcactt

SEQ ID NO: 2200 - DNA, 19 bp, Artificial Sequence
  Description of Artificial Sequence: Synthetic primer
ggtggtgatcaagccctca

SEQ ID NO: 2201 - DNA, 19 bp, Artificial Sequence
  Description of Artificial Sequence: Synthetic primer
catctttcccccaggcgaa

SEQ ID NO: 2202 - DNA, 19 bp, Artificial Sequence
  Description of Artificial Sequence: Synthetic primer
ggtggtgatcaagcccagc

SEQ ID NO: 2203 - DNA, 20 bp, Artificial Sequence
  Description of Artificial Sequence: Synthetic primer
catccatccctccgttctca

SEQ ID NO: 2204 - DNA, 25 bp, Artificial Sequence
  Description of Artificial Sequence: Synthetic primer
ctctacggcctttagtcagtctatg

SEQ ID NO: 2205 - DNA, 20 bp, Artificial Sequence
  Description of Artificial Sequence: Synthetic primer
catccatccctccgttcagc

SEQ ID NO: 2206 - DNA, 18 bp, Artificial Sequence
  Description of Artificial Sequence: Synthetic primer
gatgccacacgccagttt

SEQ ID NO: 2207 - DNA, 22 bp, Artificial Sequence
  Description of Artificial Sequence: Synthetic primer
gataaagatcggcggcattacg

SEQ ID NO: 2208 - DNA, 18 bp, Artificial Sequence
  Description of Artificial Sequence: Synthetic primer
gatgccacacgccagttc

SEQ ID NO: 2209 - DNA, 26 bp, Artificial Sequence
  Description of Artificial Sequence: Synthetic primer
tggagttcaaatttaccccgtttaag

SEQ ID NO: 2210 - DNA, 30 bp, Artificial Sequence
  Description of Artificial Sequence: Synthetic primer
acgaagaaatacccataacaataaatgaat

SEQ ID NO: 2211 - DNA, 26 bp, Artificial Sequence
  Description of Artificial Sequence: Synthetic primer
tggagttcaaatttaccccgttttaa

SEQ ID NO: 2212 - DNA, 21 bp, Artificial Sequence
  Description of Artificial Sequence: Synthetic primer
ctgaatctgacggcggaacta

SEQ ID NO: 2213 - DNA, 24 bp, Artificial Sequence
  Description of Artificial Sequence: Synthetic primer
acgggtaaagatggggtttatcat

SEQ ID NO: 2214 - DNA, 21 bp, Artificial Sequence
  Description of Artificial Sequence: Synthetic primer
ctgaatctgacggcggaattg

SEQ ID NO: 2215 - DNA, 27 bp, Artificial Sequence
  Description of Artificial Sequence: Synthetic primer
ctttctcgatcaggtctatcaagtttc

SEQ ID NO: 2216 - DNA, 21 bp, Artificial Sequence
  Description of Artificial Sequence: Synthetic primer
tcaatcaggcggatgatctcg

SEQ ID NO: 2217 - DNA, 27 bp, Artificial Sequence
  Description of Artificial Sequence: Synthetic primer
ctttctcgatcaggtctatcaggtcag

SEQ ID NO: 2218 - DNA, 19 bp, Artificial Sequence
  Description of Artificial Sequence: Synthetic primer
gaaatgccggtggtcttgg

SEQ ID NO: 2219 - DNA, 20 bp, Artificial Sequence
  Description of Artificial Sequence: Synthetic primer
ggcgtcatcaccttgatcga

SEQ ID NO: 2220 - DNA, 19 bp, Artificial Sequence
  Description of Artificial Sequence: Synthetic primer
ctaatgccggtggtcttgc

SEQ ID NO: 2221 - DNA, 22 bp, Artificial Sequence
  Description of Artificial Sequence: Synthetic primer
cctcgaaatcccgtgacaactc

SEQ ID NO: 2222 - DNA, 30 bp, Artificial Sequence
  Description of Artificial Sequence: Synthetic primer
ttttttaatgaatttgctggttgaaaaatc

SEQ ID NO: 2223 - DNA, 22 bp, Artificial Sequence
  Description of Artificial Sequence: Synthetic primer
ccagtaaatcccgtgacaacag

SEQ ID NO: 2224 - DNA, 20 bp, Artificial Sequence
  Description of Artificial Sequence: Synthetic primer
caatctcgccattgtgacgt

SEQ ID NO: 2225 - DNA, 27 bp, Artificial Sequence
  Description of Artificial Sequence: Synthetic primer
gaaacagaaagtgatcgtcaaacatct

SEQ ID NO: 2226 - DNA, 20 bp, Artificial Sequence
  Description of Artificial Sequence: Synthetic primer
caatctcgccattgtgacgc

SEQ ID NO: 2227 - DNA, 31 bp, Artificial Sequence
  Description of Artificial Sequence: Synthetic primer
tgtactaccatatattaatgaacagcgtctt

SEQ ID NO: 2228 - DNA, 22 bp, Artificial Sequence
  Description of Artificial Sequence: Synthetic primer
gcaagaaaatggcggaagaatt

SEQ ID NO: 2229 - DNA, 31 bp, Artificial Sequence
  Description of Artificial Sequence: Synthetic primer
tgtattaccatatattaatgaacagcgttta

SEQ ID NO: 2230 - DNA, 24 bp, Artificial Sequence
  Description of Artificial Sequence: Synthetic primer
ctacctgccaattcatcatcatca

SEQ ID NO: 2231 - DNA, 25 bp, Artificial Sequence
  Description of Artificial Sequence: Synthetic primer
atacagatgaatcgtacgcgtttag

SEQ ID NO: 2232 - DNA, 24 bp, Artificial Sequence
  Description of Artificial Sequence: Synthetic primer
ctacctgccaatagttcaagtagt

SEQ ID NO: 2233 - DNA, 18 bp, Artificial Sequence
  Description of Artificial Sequence: Synthetic primer
ccacgacgatgcaggaag

SEQ ID NO: 2234 - DNA, 30 bp, Artificial Sequence
  Description of Artificial Sequence: Synthetic primer
gctaagataattatactcaacggattcacc

SEQ ID NO: 2235 - DNA, 18 bp, Artificial Sequence
  Description of Artificial Sequence: Synthetic primer
ccacgacgatgcaggcac

SEQ ID NO: 2236 - DNA, 22 bp, Artificial Sequence
  Description of Artificial Sequence: Synthetic primer
gcccgacacctgaatctactag

SEQ ID NO: 2237 - DNA, 25 bp, Artificial Sequence
  Description of Artificial Sequence: Synthetic primer
gctgtttattgccattgttattgcg

SEQ ID NO: 2238 - DNA, 22 bp, Artificial Sequence
  Description of Artificial Sequence: Synthetic primer
gcccgacaccgctatctactaa

SEQ ID NO: 2239 - DNA, 25 bp, Artificial Sequence
  Description of Artificial Sequence: Synthetic primer
gtatacccatcatctgctggaatct

SEQ ID NO: 2240 - DNA, 20 bp, Artificial Sequence
  Description of Artificial Sequence: Synthetic primer
gcccactttatcccaatccg

SEQ ID NO: 2241 - DNA, 25 bp, Artificial Sequence
  Description of Artificial Sequence: Synthetic primer
gtatacccatcatctgctggaaagc

SEQ ID NO: 2242 - DNA, 26 bp, Artificial Sequence
  Description of Artificial Sequence: Synthetic primer
gcattgttcatgttatctgctgaaag

SEQ ID NO: 2243 - DNA, 26 bp, Artificial Sequence
  Description of Artificial Sequence: Synthetic primer
ggtaaatccgtacttatcatcaccgt

SEQ ID NO: 2244 - DNA, 26 bp, Artificial Sequence
  Description of Artificial Sequence: Synthetic primer
gcattgttcatgttatctgcgcttaa

SEQ ID NO: 2245 - DNA, 24 bp, Artificial Sequence
  Description of Artificial Sequence: Synthetic primer
tcacaaacagaacgtggatcttct

SEQ ID NO: 2246 - DNA, 20 bp, Artificial Sequence
  Description of Artificial Sequence: Synthetic primer
cgggagggggcatcatttaa

SEQ ID NO: 2247 - DNA, 24 bp, Artificial Sequence
  Description of Artificial Sequence: Synthetic primer
tcacaaacagaacgtggatcttca

SEQ ID NO: 2248 - DNA, 22 bp, Artificial Sequence
  Description of Artificial Sequence: Synthetic primer
cgtcgattctcaggcacaatca

SEQ ID NO: 2249 - DNA, 24 bp, Artificial Sequence
  Description of Artificial Sequence: Synthetic primer
gctggactggctttggataaaatt

SEQ ID NO: 2250 - DNA, 22 bp, Artificial Sequence
  Description of Artificial Sequence: Synthetic primer
cgtcgattctcaggcacaaagt

SEQ ID NO: 2251 - DNA, 22 bp, Artificial Sequence
  Description of Artificial Sequence: Synthetic primer
tgatggacgtgaaagtgggttc

SEQ ID NO: 2252 - DNA, 19 bp, Artificial Sequence
  Description of Artificial Sequence: Synthetic primer
agcaccgcctgtagtttcg

SEQ ID NO: 2253 - DNA, 22 bp, Artificial Sequence
  Description of Artificial Sequence: Synthetic primer
tgatggacgtgaaagtgggtag

SEQ ID NO: 2254 - DNA, 23 bp, Artificial Sequence
  Description of Artificial Sequence: Synthetic primer
cttcagagattcgttcctgacct

SEQ ID NO: 2255 - DNA, 20 bp, Artificial Sequence
  Description of Artificial Sequence: Synthetic primer
ggctggaacaaaaccgtctg

SEQ ID NO: 2256 - DNA, 23 bp, Artificial Sequence
  Description of Artificial Sequence: Synthetic primer
cttcagagattcgttcctgaccg

SEQ ID NO: 2257 - DNA, 22 bp, Artificial Sequence
  Description of Artificial Sequence: Synthetic primer
ggataaaccgacgcttatgtca

SEQ ID NO: 2258 - DNA, 23 bp, Artificial Sequence
  Description of Artificial Sequence: Synthetic primer
tggtaggcattcttaagcaggtc

SEQ ID NO: 2259 - DNA, 22 bp, Artificial Sequence
  Description of Artificial Sequence: Synthetic primer
ggataaaccgacgttgatgagc

SEQ ID NO: 2260 - DNA, 20 bp, Artificial Sequence
  Description of Artificial Sequence: Synthetic primer
cagaaagatcgccggtacct

SEQ ID NO: 2261 - DNA, 22 bp, Artificial Sequence
  Description of Artificial Sequence: Synthetic primer
cgtggtattggtgtggtgaaag

SEQ ID NO: 2262 - DNA, 20 bp, Artificial Sequence
  Description of Artificial Sequence: Synthetic primer
cagaaagatcgccggtaccg

SEQ ID NO: 2263 - DNA, 42 bp, Artificial Sequence
  Description of Artificial Sequence: Synthetic oligonucleotide
  CDS (1)..(24)
cagaacaccacagagagggaattatgagccagtttttttata

SEQ ID NO: 2264 - protein, 8 aa, Artificial Sequence
  Description of Artificial Sequence: Synthetic peptide
QNTTEREL

SEQ ID NO: 2265 - DNA, 45 bp, Artificial Sequence
  Description of Artificial Sequence: Synthetic oligonucleotide
  CDS (1)..(24)
cagaacaccacagagcgggaactttgatgtcacagtttttttata

SEQ ID NO: 2266 - DNA, 61 bp, Artificial Sequence
  Description of Artificial Sequence: Synthetic oligonucleotide
  CDS (1)..(30)
  CDS (32)..(61)
caaaaaagagaaaataacaggagtgatgactatgagtcgtttagtcgtagtatctaaccgg

SEQ ID NO: 2267 - protein, 10 aa, Artificial Sequence
  Description of Artificial Sequence: Synthetic peptide
QKRENNRSDD

SEQ ID NO: 2268 - DNA, 107 bp, Artificial Sequence
  Description of Artificial Sequence: Synthetic polynucleotide
  CDS (1)..(54)
  CDS (78)..(107)
caaaaacgtgagaacaatcgatcagacgattatgagtctttctctcgatcaatttgaaaataacaggagtgatgactatgtcacgtctagtcgtagtatctaaccgg

SEQ ID NO: 2269 - protein, 18 aa, Artificial Sequence
  Description of Artificial Sequence: Synthetic peptide
QKRENNRSDDYESFSRSI

SEQ ID NO: 2270 - protein, 10 aa, Artificial Sequence
  Description of Artificial Sequence: Synthetic peptide
MSRLVVVSNR

SEQ ID NO: 2271 - DNA, 49 bp, Artificial Sequence
  Description of Artificial Sequence: Synthetic oligonucleotide
  CDS (8)..(49)
taatacgatgatcaaacaaaggacacttaaacgtatcgttcaggcgacg

SEQ ID NO: 2272 - protein, 14 aa, Artificial Sequence
  Description of Artificial Sequence: Synthetic peptide
MIKQRTLKRIVQAT

SEQ ID NO: 2273 - DNA, 49 bp, Artificial Sequence
  Description of Artificial Sequence: Synthetic oligonucleotide
  CDS (8)..(49)
taatacgatgatcaaacaacgtacacttaaacgtatcgttcaggcgacg

SEQ ID NO: 2274 - DNA, 21 bp, Artificial Sequence
  Description of Artificial Sequence: Synthetic oligonucleotide
  CDS (1)..(21)
cgcttgtgggagacgttacgc

SEQ ID NO: 2275 - protein, 7 aa, Artificial Sequence
  Description of Artificial Sequence: Synthetic peptide
RLWETLR

SEQ ID NO: 2276 - DNA, 21 bp, Artificial Sequence
  Description of Artificial Sequence: Synthetic oligonucleotide
  CDS (1)..(21)
cgcctatgggaaactcttcgc

SEQ ID NO: 2277 - DNA, 21 bp, Artificial Sequence
  Description of Artificial Sequence: Synthetic oligonucleotide
  CDS (1)..(21)
gtgattaaaaaaaaatactgt

SEQ ID NO: 2278 - protein, 7 aa, Artificial Sequence
  Description of Artificial Sequence: Synthetic peptide
VIKKKYC

SEQ ID NO: 2279 - DNA, 22 bp, Artificial Sequence
  Description of Artificial Sequence: Synthetic oligonucleotide
  CDS (2)..(22)
ggtgattaagaagaagtactgt

SEQ ID NO: 2280 - RNA, 16 nt, Artificial Sequence
  Description of Artificial Sequence: Synthetic oligonucleotide
gguggcagaucguaau

SEQ ID NO: 2281 - RNA, 16 nt, Artificial Sequence
  Description of Artificial Sequence: Synthetic oligonucleotide
gguggccguucguaau

SEQ ID NO: 2282 - RNA, 16 nt, Artificial Sequence
  Description of Artificial Sequence: Synthetic oligonucleotide
gguggccgaucguaau

SEQ ID NO: 2283 - protein, 4 aa, Artificial Sequence
  Description of Artificial Sequence: Synthetic peptide
GGRS

SEQ ID NO: 2284 - protein, 4 aa, Artificial Sequence
  Description of Artificial Sequence: Synthetic peptide
ADRN

SEQ ID NO: 2285 - protein, 4 aa, Artificial Sequence
  Description of Artificial Sequence: Synthetic peptide
AVRN

SEQ ID NO: 2286 - DNA, 22 bp, Artificial Sequence
  Description of Artificial Sequence: Synthetic oligonucleotide
  Description of Combined DNA/RNA Molecule: Synthetic oligonucleotide
atgcugagguucugagaugucu

SEQ ID NO: 2287 - DNA, 22 bp, Artificial Sequence
  Description of Artificial Sequence: Synthetic oligonucleotide
  Description of Combined DNA/RNA Molecule: Synthetic oligonucleotide
atgcugcguuucugagaugucu

SEQ ID NO: 2288 - DNA, 22 bp, Artificial Sequence
  Description of Artificial Sequence: Synthetic oligonucleotide
  Description of Combined DNA/RNA Molecule: Synthetic oligonucleotide
atgcuggaguucugagaugucu

SEQ ID NO: 2289 - protein, 4 aa, Artificial Sequence
  Description of Artificial Sequence: Synthetic peptide
MLRF

SEQ ID NO: 2290 - protein, 4 aa, Artificial Sequence
  Description of Artificial Sequence: Synthetic peptide
MLDF

SEQ ID NO: 2291 - RNA, 30 nt, Artificial Sequence
  Description of Artificial Sequence: Synthetic oligonucleotide
auggccagcagaggcguaaacaagguuauu

SEQ ID NO: 2292 - RNA, 30 nt, Artificial Sequence
  Description of Artificial Sequence: Synthetic oligonucleotide
auggccagccguggcguaaacaagguuauu

SEQ ID NO: 2293 - RNA, 30 nt, Artificial Sequence
  Description of Artificial Sequence: Synthetic oligonucleotide
auggcgagucgagguguuaauaagguaauu

SEQ ID NO: 2294 - protein, 9 aa, Artificial Sequence
  Description of Artificial Sequence: Synthetic peptide
ASRGVNKVI

SEQ ID NO: 2295 - DNA, 45 bp, Artificial Sequence
  Description of Artificial Sequence: Synthetic oligonucleotide
gtggttaagctcgcatttcccagggagttacgcttgttaactccc

SEQ ID NO: 2296 - DNA, 45 bp, Artificial Sequence
  Description of Artificial Sequence: Synthetic oligonucleotide
  Description of Combined DNA/RNA Molecule: Synthetic oligonucleotide
gtggttaagctcgcatttccccgugagttacgcttgttaactccc

SEQ ID NO: 2297 - DNA, 45 bp, Artificial Sequence
  Description of Artificial Sequence: Synthetic oligonucleotide
gtggttaagctcgcatttccccgggagttacgcttgttaactccc

SEQ ID NO: 2298 - protein, 14 aa, Artificial Sequence
  Description of Artificial Sequence: Synthetic peptide
VKLAFPRELRLLTP

SEQ ID NO: 2299 - RNA, 21 nt, Artificial Sequence
  Description of Artificial Sequence: Synthetic oligonucleotide
uuggacgcaugagaugguauc

SEQ ID NO: 2300 - RNA, 21 nt, Artificial Sequence
  Description of Artificial Sequence: Synthetic oligonucleotide
uuggacgcaugcguugguauc

SEQ ID NO: 2301 - RNA, 24 nt, Artificial Sequence
  Description of Artificial Sequence: Synthetic oligonucleotide
uuggacgcauaaugcgcugguauc

SEQ ID NO: 2302 - protein, 7 aa, Artificial Sequence
  Description of Artificial Sequence: Synthetic peptide
  MOD_RES (4)..(4): Cys or not present
LDAXVGI

SEQ ID NO: 2303 - RNA, 20 nt, Artificial Sequence
  Description of Artificial Sequence: Synthetic oligonucleotide
uucagaggguaacgaugaaa

SEQ ID NO: 2304 - RNA, 20 nt, Artificial Sequence
  Description of Artificial Sequence: Synthetic oligonucleotide
uuccguggguaacgaugaaa

SEQ ID NO: 2305 - RNA, 20 nt, Artificial Sequence
  Description of Artificial Sequence: Synthetic oligonucleotide
uuccgaggguaacgaugaaa

SEQ ID NO: 2306 - RNA, 25 nt, Artificial Sequence
  Description of Artificial Sequence: Synthetic oligonucleotide
aggagaagcggugggaaguaaguuu

SEQ ID NO: 2307 - RNA, 25 nt, Artificial Sequence
  Description of Artificial Sequence: Synthetic oligonucleotide
cgucguagcgguggcaaguaaguuu

SEQ ID NO: 2308 - RNA, 25 nt, Artificial Sequence
  Description of Artificial Sequence: Synthetic oligonucleotide
cggcgaagcgauggcaaguaaguuu

SEQ ID NO: 2309 - protein, 6 aa, Artificial Sequence
  Description of Artificial Sequence: Synthetic peptide
RRSGGK

SEQ ID NO: 2310 - protein, 4 aa, Artificial Sequence
  Description of Artificial Sequence: Synthetic peptide
RRSG

SEQ ID NO: 2311 - protein, 4 aa, Artificial Sequence
  Description of Artificial Sequence: Synthetic peptide
RRSD

SEQ ID NO: 2312 - protein, 4 aa, Artificial Sequence
  Description of Artificial Sequence: Synthetic peptide
ASKF

SEQ ID NO: 2313 - RNA, 24 nt, Artificial Sequence
  Description of Artificial Sequence: Synthetic oligonucleotide
augucuuccagaguuuugaccccg

SEQ ID NO: 2314 - RNA, 24 nt, Artificial Sequence
  Description of Artificial Sequence: Synthetic oligonucleotide
augucuucccguguuuugaccccg

SEQ ID NO: 2315 - RNA, 24 nt, Artificial Sequence
  Description of Artificial Sequence: Synthetic oligonucleotide
augucaucucguguuuugacgccg

SEQ ID NO: 2316 - protein, 7 aa, Artificial Sequence
  Description of Artificial Sequence: Synthetic peptide
SSRVLTP

SEQ ID NO: 2317 - RNA, 19 nt, Artificial Sequence
  Description of Artificial Sequence: Synthetic oligonucleotide
cuuaggggguaucuuugac

SEQ ID NO: 2318 - RNA, 19 nt, Artificial Sequence
  Description of Artificial Sequence: Synthetic oligonucleotide
cuucguggguaucuuugac

SEQ ID NO: 2319 - RNA, 19 nt, Artificial Sequence
  Description of Artificial Sequence: Synthetic oligonucleotide
cuacggggguaucuuugac

SEQ ID NO: 2320 - RNA, 18 nt, Artificial Sequence
  Description of Artificial Sequence: Synthetic oligonucleotide
cuucguggguaucuugac

SEQ ID NO: 2321 - protein, 6 aa, Artificial Sequence
  Description of Artificial Sequence: Synthetic peptide
LRGYLD

SEQ ID NO: 2322 - protein, 5 aa, Artificial Sequence
  Description of Artificial Sequence: Synthetic peptide
LRGYL

SEQ ID NO: 2323 - DNA, 61 bp, Artificial Sequence
  Description of Artificial Sequence: Synthetic oligonucleotide
caggacctcacggaacgctccgacgttcttagggggtatctttgactacgacgccaagaaa

SEQ ID NO: 2324 - DNA, 61 bp, Artificial Sequence
  Description of Artificial Sequence: Synthetic oligonucleotide
tttttttcaggagacacgaacatggccagcagaggcgtaaacaaggttattctcgttggta

SEQ ID NO: 2325 - DNA, 61 bp, Artificial Sequence
  Description of Artificial Sequence: Synthetic oligonucleotide
gttccatatttgagaaacagtatgtcttccagagttttgaccccggacgtcgttggtattg

SEQ ID NO: 2326 - DNA, 23 bp, Artificial Sequence
  Description of Artificial Sequence: Synthetic primer
cagggatgcaaaatagtgttgag

SEQ ID NO: 2327 - DNA, 17 bp, Artificial Sequence
  Description of Artificial Sequence: Synthetic primer
gagaagtccgcgtgagg

SEQ ID NO: 2328 - DNA, 20 bp, Artificial Sequence
  Description of Artificial Sequence: Synthetic primer
gcgctaatgctctgttacag

SEQ ID NO: 2329 - DNA, 30 bp, Artificial Sequence
  Description of Artificial Sequence: Synthetic primer
gaaatcaaataatgattttattttgactga

SEQ ID NO: 2330 - DNA, 20 bp, Artificial Sequence
  Description of Artificial Sequence: Synthetic oligonucleotide
tcagcttttttatactaagt

What is claimed is:

1. A method comprising
   (a) providing viable bacterial cells, wherein the viable bacterial cells comprise a recoded genome, wherein the recoded genome comprises at least one particular sense codon at all instances within an essential gene in a corresponding template genome that is changed to an alternative codon, wherein:
      (i) the recoded genome comprises at least one instance where the at least one particular sense codon is reassigned to at least one non-standard amino acid, and wherein a gene encoding a cognate tRNA to the at least one particular sense codon is removed from the recoded genome; and
      (ii) the recoded genome comprises at least one instance where a trinucleotide sequence corresponding to the sequence of the at least one particular sense codon that is changed to an alternative codon (A) is changed to a trinucleotide sequence corresponding to the sequence of the alternative codon and (B) is within a non-coding motif that is an untranslated motif selected from the group consisting of a ribosome binding site motif, an mRNA secondary structure, an internal ribosome pausing site motif, a promoter and combinations thereof, wherein the trinucleotide sequence corresponding to the sequence of the alternative codon that is within the non-coding motif preserves a structure or function of the non-coding motif, and wherein the trinucleotide sequence corresponding to the sequence of the alternative codon and that is within the non-coding motif is a trinucleotide sequence corresponding to sequence of a non-synonymous codon with respect to the at least one particular sense codon;

wherein the at least one particular sense codon is selected from the group consisting of AGG, AGA, AGC, AGU, UUG, UUA; and (b) culturing the viable bacterial cells in growth media that comprises the at least one non-standard amino acid.

2. The method of claim 1, wherein the recoded genome comprises at least two particular sense codons in a corresponding template genome that are changed to an alternative codon genome-wide selected from the group consisting of at least two of AGG, AGA, AGC, AGU, UUG, and UUA.

3. The method of claim 2, wherein the recoded genome comprises at least seven particular sense codons in the corresponding template genome that are changed to an alternative codon, wherein the at least seven particular sense codons comprise AGG, AGA, AGC, AGU, UUG, and UUA.

4. The method of claim 1, wherein all UAG codons are removed from the recoded genome.

5. The method of claim 1, wherein a gene encoding a release factor is removed from the recoded genome.

6. The method of claim 1, wherein the at least one non-standard amino acid is incorporated into an endogenous polypeptide expressed by the viable bacterial cells.

7. The method of claim 1, wherein the viable bacterial cells are a non-standard amino acid dependent version of a 57 codon gene or a biocontained strain in which all UAG codons have been removed and two essential genes have been altered to require the at least one non-standard amino acid to remain viable.

8. The method of claim 7, wherein the two essential genes that have been altered to require the at least one non-standard amino acid are adk and tyrS.

9. The method of claim 1, wherein the viable bacterial cells are multi-virus resistant bacterial cells.

10. The method of claim 1, wherein the viable bacterial cells have a decrease in fitness of no more than 20% calculated by a doubling time when compared to parental non-recoded bacterial cells.

11. The method of claim 1, wherein the method further comprises formulating a pharmaceutical composition comprising a recombinant protein expressed by the viable bacterial cells.

12. The method of claim 1, wherein the method further comprises purifying a recombinant protein expressed by the viable bacterial cells.

13. The method of claim 1, wherein not all instances of the trinucleotide sequence corresponding to the sequence of the at least one particular sense codon within a non-coding motif of the recoded genome are changed to a trinucleotide sequence corresponding to the sequence of the alternative codon.

14. The method of claim 1, wherein the recoded genome comprises all instances of the trinucleotide sequence corresponding to the sequence of the at least one particular sense codon within a non-coding motif being changed to a trinucleotide sequence corresponding to the sequence of the alternative codon.

15. Viable bacterial cells comprising a recoded genome, wherein the recoded genome comprises at least one particular sense codon at all instances within an essential gene in a corresponding template genome that is changed to an alternative codon, wherein:

(i) the recoded genome comprises at least one instance where the at least one particular sense codon is reassigned to at least one non-standard amino acid, and wherein a gene encoding a cognate tRNA to the at least one particular sense codon is removed from the recoded genome; and (ii) the recoded genome comprises at least one instance where a trinucleotide sequence corresponding to the sequence of the at least one particular sense codon that is changed to an alternative codon (A) is changed to a trinucleotide sequence corresponding to the sequence of the alternative codon and (B) is within a non-coding motif that is an untranslated motif selected from the group consisting of a ribosome binding site motif, an mRNA secondary structure, an internal ribosome pausing site motif, a promoter and combinations thereof, wherein the trinucleotide sequence corresponding to the sequence of the alternative codon that is within the non-coding motif preserves a structure or function of the non-coding motif, and wherein the trinucleotide sequence corresponding to the sequence of the alternative codon and that is within the non-coding motif is a trinucleotide sequence corresponding to sequence of a non-synonymous codon with respect to the at least one particular sense codon;

wherein the at least one particular sense codon is selected from the group consisting of AGG, AGA, AGC, AGU, UUG, UUA.

16. The method of claim 1, wherein the recoded genome comprises the at least one particular sense codon in a corresponding template genome that is changed to an alternative codon genome-wide.

17. The viable bacterial cells of claim 15, wherein the viable bacterial cells require the at least one non-standard amino acid to remain viable.

* * * * *